(12) United States Patent
Nabel et al.

(10) Patent No.: US 11,904,009 B2
(45) Date of Patent: Feb. 20, 2024

(54) FERRITIN PROTEINS

(71) Applicant: SANOFI, Paris (FR)

(72) Inventors: Gary J. Nabel, Bridgewater, NJ (US); Chih-Jen Wei, Bridgewater, NJ (US); Kurt Swanson, Bridgewater, NJ (US)

(73) Assignee: SANOFI, Paris (FR)

( * ) Notice: Subject to any disclaimer, the term of this patent is extended or adjusted under 35 U.S.C. 154(b) by 485 days.

(21) Appl. No.: 17/061,136

(22) Filed: Oct. 1, 2020

(65) Prior Publication Data

US 2021/0113681 A1 Apr. 22, 2021

Related U.S. Application Data

(63) Continuation of application No. PCT/US2019/025422, filed on Apr. 2, 2019.

(60) Provisional application No. 62/652,199, filed on Apr. 3, 2018, provisional application No. 62/652,210, filed on Apr. 3, 2018, provisional application No. 62/652,201, filed on Apr. 3, 2018, provisional application No. 62/652,217, filed on Apr. 3, 2018, provisional application No. 62/652,204, filed on Apr. 3, 2018.

(51) Int. Cl.
| | | |
|---|---|---|
| *A61K 39/02* | (2006.01) | |
| *A61P 37/04* | (2006.01) | |
| *A61P 31/04* | (2006.01) | |
| *A61P 31/16* | (2006.01) | |
| *C07K 14/005* | (2006.01) | |
| *C07K 14/195* | (2006.01) | |

(52) U.S. Cl.
CPC ........ *A61K 39/105* (2013.01); *A61K 39/0225* (2013.01); *A61P 31/04* (2018.01); *A61P 31/16* (2018.01); *A61P 37/04* (2018.01); *C07K 14/005* (2013.01); *C07K 14/195* (2013.01); *C07K 2319/00* (2013.01); *C12N 2710/16222* (2013.01); *C12N 2710/16234* (2013.01); *C12N 2760/16122* (2013.01); *C12N 2760/16134* (2013.01); *C12N 2760/18522* (2013.01); *C12N 2760/18534* (2013.01)

(58) Field of Classification Search
None
See application file for complete search history.

(56) References Cited

U.S. PATENT DOCUMENTS

| | | |
|---|---|---|
| 6,194,388 B1 | 2/2001 | Krieg et al. |
| 6,207,646 B1 | 3/2001 | Krieg et al. |
| 6,214,806 B1 | 4/2001 | Krieg et al. |
| 6,218,371 B1 | 4/2001 | Krieg et al. |
| 6,239,116 B1 | 5/2001 | Krieg et al. |
| 6,339,068 B1 | 1/2002 | Krieg et al. |
| 6,406,705 B1 | 6/2002 | Davis et al. |
| 6,429,199 B1 | 8/2002 | Krieg et al. |
| 8,562,996 B2 | 10/2013 | Spits et al. |
| 9,703,095 B2 | 7/2017 | Pakhchyan |
| 10,961,283 B2 | 3/2021 | Kwong et al. |
| 2012/0267258 A1 | 10/2012 | Uraoka et al. |
| 2014/0072958 A1 | 3/2014 | Nabel et al. |
| 2014/0348865 A1 | 11/2014 | Kwong et al. |
| 2016/0303224 A1* | 10/2016 | Kanekiyo ............ C07K 16/085 |
| 2020/0282047 A1 | 9/2020 | Ciaramella et al. |

FOREIGN PATENT DOCUMENTS

| | | |
|---|---|---|
| CA | 2485363 C | 10/2014 |
| EP | 2515112 B1 | 8/2015 |
| JP | 2006104216 A | 4/2006 |
| JP | 2011506565 A | 3/2011 |
| JP | 2012225885 A | 11/2012 |
| JP | 2013529078 A | 7/2013 |
| JP | 2014513678 A | 6/2014 |
| JP | 2014530003 A | 11/2014 |
| JP | 2015530369 A | 10/2015 |
| JP | 2020520674 A | 7/2020 |
| JP | 2021504445 A | 2/2021 |
| WO | 9506124 A1 | 3/1995 |
| WO | 2002016421 A2 | 2/2002 |
| WO | 2009080719 A1 | 7/2009 |
| WO | 2009126816 A1 | 10/2009 |
| WO | 2011143623 A1 | 11/2011 |
| WO | 2012006180 A1 | 1/2012 |
| WO | 2012139069 A2 | 10/2012 |
| WO | 2013039792 A1 | 3/2013 |
| WO | 2013043729 A1 | 3/2013 |
| WO | 2013044203 A2 | 3/2013 |
| WO | 2014018858 A2 | 1/2014 |
| WO | 2014160463 A1 | 10/2014 |
| WO | 2015054639 A1 | 4/2015 |

(Continued)

OTHER PUBLICATIONS

Dawson et al. Nature vol. 349, pp. 541-544 (Year: 1991).*
Hu et al. Chem Soc Rev. 21;45(6):1691-719). (Year: 2016).*
Moyle et al., Bioconjugate Chem. 2014, 25, 5, 965-978 (Year: 2014).*
Zipeng Zhen, Wei Tang, Trever Todd & Jin Xie (2014) Ferritins as nanoplatforms for imaging and drug delivery, Expert Opinion on Drug Delivery, 11:12, 1913-1922 (Year: 2014).*
Balfour, Progress, prospects, and problems in Epstein-Barr virus vaccine development, Current Opinion in Virology, vol. 6, pp. 1-5 (Year: 2014).*

(Continued)

*Primary Examiner* — Shanon A. Foley
*Assistant Examiner* — Myron G Hill
(74) *Attorney, Agent, or Firm* — McNeill Baur PLLC

(57) ABSTRACT

Ferritin proteins comprising a mutation replacing a surface-exposed amino acid with a cysteine, an N- or C-terminal linker comprising a cysteine, and/or one or more immune-stimulatory moieties linked to the ferritin protein via a surface-exposed amino acid are disclosed. The ferritin proteins can further comprise a non-ferritin polypeptide and be antigenic, e.g., for use in eliciting antibodies against the non-ferritin polypeptide.

16 Claims, 199 Drawing Sheets

Specification includes a Sequence Listing.

(56) References Cited

FOREIGN PATENT DOCUMENTS

| | | | |
|---|---|---|---|
| WO | 2015169271 | A1 | 11/2015 |
| WO | 2015183969 | A1 | 12/2015 |
| WO | 2016138160 | A1 | 9/2016 |
| WO | 2017096374 | A1 | 6/2017 |
| WO | 2017172890 | A1 | 10/2017 |
| WO | 2017211886 | A1 | 12/2017 |
| WO | 2017218819 | A1 | 12/2017 |
| WO | 2018005558 | A1 | 1/2018 |
| WO | 2018193063 | A2 | 10/2018 |
| WO | 2019103993 | A1 | 5/2019 |
| WO | 2019195276 | A1 | 10/2019 |
| WO | 2019195284 | A1 | 10/2019 |
| WO | 2019195291 | A1 | 10/2019 |
| WO | 2019195314 | A2 | 10/2019 |
| WO | 2019195316 | A1 | 10/2019 |

OTHER PUBLICATIONS

Sequence #206 comparison (Year: 2023).*
Alvarez-Cienfuegos et al., "Intramolecular trimerization, a novel strategy for making multispecific antibodies with controlled orientation of the antigen binding domains", Scientific Reports 2016; 6:28643 (Jun. 2016).
Aslam et al., "The accuracy of protein structure alignment servers", Electronic Journal of Biotechnology, 20, pp. 9-13 (2016).
Bordoli et al., "Protein structure homology modeling using SWISS-MODEL workspace", Nature Protocols, 4(1), pp. 1-13 (2009).
Bu et al., "Immunization with Components of the Viral Fusion Apparatus Elicits Antibodies That Neutralize Epstein-Barr Virus in B Cells and Epithelial Cells", Immunity, 50, pp. 1305-1316 (2019).
Carter et al., "Design and Characterization of a Computationally Optimized Broadly Reactive Hemagglutinin Vaccine for H1N1 Influenza Viruses", J Virol, 90(9), pp. 4720-4734 (May 1, 2016).
Chapter 4 of Holtzhauer, M., Basic Methods for the Biochemical Lab, Springer 2006, ISBN 978-3-540-32785-1, available from www.springer.com.
Cui et al., "Rabbits immunized with Epstein-Barr virus gH/gL or GB recombinant proteins elicit higher serum virus neutralizing activity than gp350" Vaccine, 34(34), pp. 4050-4055 (Jul. 25, 2016).
Danilchanka et al., "Cyclic Dinucleotides and the Innate Immune Response", Cell, 154, pp. 962-970 (Aug. 29, 2013).
DiLillo et al., "Broadly neutralizing hemagglutinin stalk-specific antibodies require FcγR interactions for protection against influenza virus in vivo", Nature Medicine 20(2), pp. 143-151 (2014).
Fallon et al., "An Adjuvanted, Postfusion F Protein-Based Vaccine Did Not Prevent Respiratory Syncytial Virus Illness in Older Adults", J Infect Dis., 216, pp. 1362-1370 (Dec. 1, 2017).
Gaydos et al., "Swine Influenza A Outbreak, Fort Dix, New Jersey, 1976", Emerg Infect Dis, 12(1), pp. 23-28 (1976).
GenBank Accession Nos. CEQ35765.1 (Sep. 24, 2015) (2 pages).
GenBank Accession Nos. YP_001129472.1 (Aug. 13, 2018) (2 pages).
Gomes et al., "Harnessing Nanoparticles for Immunomodulation and Vaccines", Vaccines, 5(1), p. 6, (Feb. 14, 2017).
Gross et al., "Identification of LFA-1 as a candidate autoantigen in treatment-resistant Lyme arthritis", Science, 281 (5377), pp. 703-706 (1998).
Hein et al., "Click Chemistry, a Powerful Tool for Pharmaceutical Sciences", Pharm Res, 25(10), pp. 2216-2230 (Oct. 2008).
Hu et al., "Towards the next generation of biomedicines by site-selective conjugation", Chemical Society Reviews, 45(6), pp. 1691-1719 (Mar. 21, 2016).
Hurwitz, J., "Respiratory syncytial virus vaccine development", Expert Rev Vaccines, 10(10), pp. 1415-1433 (Oct. 2011).
International Search Report issued in PCT Application No. PCT/US2019/025422 dated Sep. 4, 2019 (8 pages).
Kanekiyo et al., "Rational Design of an Epstein-Barr Virus Vaccine Targeting the Receptor-Binding Site", Cell, 162(5), pp. 1090-1100 (Aug. 27, 2015).
Kanekiyo et al., "Self-assembling influenza nanoparticle vaccines elicit broadly neutralizing H1N1 antibodies", Nature, 499(7456), pp. 102-106 (Jul. 4, 2013).
Khazina et al., "Non-LTR retrotransposons encode noncanonical RRMdomains in their first open reading frame", Proc Natl Acad Sci U S A; 106(3), pp. 731-736 (Jan. 20, 2009).
Kim et al., "Efficient Site-Specific Labeling of Proteins via Cysteines", Bioconjugate Chemistry, 19(3), pp. 786-791 (Mar. 1, 2008).
Kitahara, et al., "A Delicate Interplay of Structure, Dynamics, and Thermodynamics for Function: A High Pressure NMR Study of Outer Surface Protein A", Biophys J 102(4), pp. 916-926 (2012).
Klucker et al., "AF03, An Alternative Squalene Emulsion-Based Vaccine Adjuvant Prepared by a Phase Inversion Temperature Method", J Pharm Sci., 101(12), pp. 4490-4500 (Dec. 2012).
Lander, et al., "Appion: an integrated, database-driven pipeline to facilitate EM image processing", J Struct Biol, 166(1), pp. 95-102 (2009).
Li et al., "Ferritin nanoparticle technology . . . A new platform for antigen presentation and vaccine development", Industrial Biotechnology, 2(2), pp. 143-147 (Jul. 17, 2006).
Livey et al., "A New Approach to a Lyme Disease Vaccine", Clinical Infectious Diseases, vol. 52, Supplement 3, pp. S266-S270 (Feb. 1, 2011).
Lopez-Sagaseta et al., "Self-assembling protein nanoparticles in the design of vaccines", Computational and Structural Biotechnology Journal, vol. 14, pp. 58-68 (Jan. 1, 2016).
Lynn et al., "In vivo characterization of the physicochemical properties of polymer-linked TLR agonists that enhance vaccine immunogenicity", Nat Biotechnol., 33(11), pp. 1201-1210 (Nov. 2015).
McLellan et al., "Structure-Based Design of a Fusion Glycoprotein Vaccine for Respiratory Syncytial Virus", Science, 342(6158), pp. 592-598 (Nov. 1, 2013).
McLellan et al., "Structure of RSV Fusion Glycoprotein Trimer Bound to a Prefusion-Specific Neutralizing Antibody", Science, 340(6136), pp. 1113-1117 (2013).
McLellan, et al., "Structure of Respiratory Syncytial Virus Fusion Glycoprotein in the Postfusion Conformation Reveals Preservation of Neutralizing Epitopes", J Virol 85(15), pp. 7788-7796 (2011).
Notification of Transmittal of The International Search Report and The Written Opinion of The International Searching Authority, or the Declaration, issued in PCT Application No. PCT/US2019/025377 dated Jul. 10, 2019 (16 pages).
Notification of Transmittal of The International Search Report and The Written Opinion of The International Searching Authority, or the Declaration, issued in PCT Application No. PCT/US2019/025387 dated Jul. 9, 2019 (20 pages).
Notification of Transmittal of The International Search Report and The Written Opinion of The International Searching Authority, or the Declaration, issued in PCT Application No. PCT/US2019/025419 dated Oct. 18, 2019 (21 pages).
Notification of Transmittal of The International Search Report and The Written Opinion of The International Searching Authority, or the Declaration, issued in PCT Application No. PCT/US2019/025367 dated Jul. 9, 2019 (17 pages).
Perez et al., "Novel Epstein-Barr virus-like particles incorporating gH/gL-EBNA1 or GB-LMP2 induce high neutralizing antibody titers and EBV-specific T-cell responses in immunized mice", Oncotarget, 8(12), (Mar. 21, 2017).
Ra et al., "Lumazine synthase protein cage nanoparticles as antigen delivery nanoplatforms for dendritic cell-based vaccine development", Clin Exp Vaccine Res, 3, pp. 227-234 (2014).
Rosa et al. "The burgeoning molecular genetics of the Lyme disease spirochaete", Nat Rev Microbiol 3(2), pp. 129-143 (2005).
Sashihara et al., "Human Antibody Titers to Epstein-Barr Virus (EBV) gp350 Correlate with Neutralization of Infectivity Better than Antibody Titers to EBV gp42 Using a Rapid Flow Cytometry-Based EBV Neutralization Assay", Virology, 391(2), pp. 249-256 (Sep. 1, 2009).
Sliepen et al., "Presenting native-like HIV-1 envelope trimers on ferritin nanoparticles improves their immunogenicity", Retrovirology, 11(1), p. e1004767 (Sep. 26, 2015).

(56) References Cited

OTHER PUBLICATIONS

Sorzano et al., XMIPP: a new generation of an open-source image processing package for electron microscopy, J Struct Biol, 148(2), pp. 194-204 (2004).
Steff et al., "Pre-fusion RSV F strongly boosts pre-fusion specific neutralizing responses in cattle pre-exposed to bovine RSV", Nature Communications, 8(1) (Oct. 20, 2017) (abstract).
Swanson et al., "Structural basis for immunization with postfusion respiratory syncytial virus fusion F glycoprotein (RSV F) to elicit high neutralizing antibody titers", Proc Natl Acad Sci, 108(23), pp. 9619-9624 (2011).
Trikha, J., et al. "High Resolution Crystal Structures of Amphibian Red-Cell L Ferritin: Potential Roles for Structural Plasticity and Solvation in Function", J Mol Biol, 248(5), pp. 949-967 (1995).
Tripp et al., "Respiratory Syncytial Virus: Targeting the G Protein Provides a New Approach for an Old Problem", Journal of Virology, 92(3), pp. 1-8 (Nov. 8, 2017).
Uchida et al., "Targeting of Cancer Cells with Ferrimagnetic Ferritin Cage Nanoparticles", Journal of the American Chemical Society, 128(51), pp. 16626-16633 (Dec. 1, 2006).
Van Geel et al., "Chemoenzymatic Conjugation of Toxic Payloads to the Globally Conserved N-Glycan of Native mAbs Provides Homogeneous and Highly Efficacious Antibody-Drug Conjugates", Bioconjugate Chem., 26, pp. 2233-2242 (2015).
Wang et al., "Functional ferritin nanoparticles for biomedical applications", Frontiers of Chemical Science and Engineering, 11(4), pp. 633-646 (Feb. 15, 2017).
Khoshnejad et al., "Ferritin-based drug delivery systems; Hybrid nanocarriers for vascular immunotargeting", J. Control Release, vol. 282, p. 13-24 (Mar. 6, 2018).
Villar et al., "Reconstituted B cell receptor signaling reveals carbohydrate-dependent mode of activation", Scientific Reports, 6:36298, 11 pages (2016).
Calisti et al., "Probing bulky ligand entry in engineered archaeal ferritins", Biochimica et Biophysica Acta 1861, pp. 450-455 (2017).
Wille-Reece et al., "HIV Gag protein conjugated to a Toll-like receptor 7/8 agonist improves the magnitude and quality of Th1 and CD8+ T cell responses in nonhuman primates", Proc Natl Acad Sci, 102(42), pp. 15190-15194 (2005).
Wilske et al., "An OspA Serotyping System for Borrelia burgdorferi Based on Reactivity with Monoclonal Antibodies and OspA Sequence Analysis", J Clin Microbio, 31(2), pp. 340-350 (1993).
Wressnigg et al., "A Novel Multivalent OspA Vaccine against Lyme Borreliosis Is Safe and Immunogenic in an Adult Population Previously Infected with Borrelia burgdorferi Sensu Lato", Clinical and Vaccine Immunology, 21(11), pp. 1490-1499 (Nov. 2014).
Written Opinion of the International Searching Authority issued in PCT Application No. PCT/US2019/025422 dated Sep. 4, 2019 (13 pages).
Wu, Tom Y.-H., "Strategies for designing synthetic immune agonists", Immunology, 148(4), pp. 315-325 (Jul. 11, 2016).
Xu et al., "Trispecific broadly neutralizing HIV antibodies mediate potent SHIV protection in macaques", Science 358 (6359), pp. 85-90 (2017).
Yassine et al., "Hemagglutinin-stem nanoparticles generate heterosubtypic influenza protection", Nature Medicine 21(9), pp. 1065-1071 (2015).
Zhang et al., "Challenges of glycosylation analysis and control: an integrated approach to producing optimal and consistent therapeutic drugs", Drug Discovery Today, 21(5), pp. 740-765 (May 2016).

* cited by examiner

OspA -GS- Ferritin
*Fig. 1A*
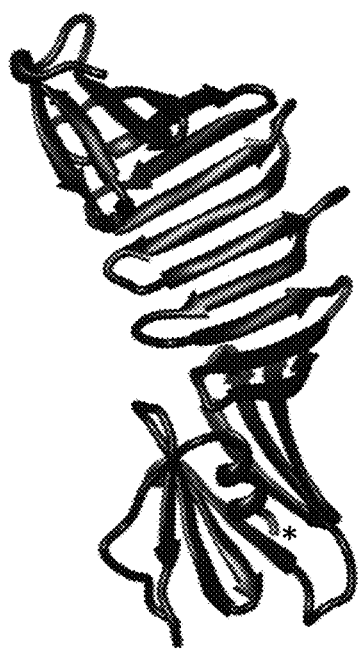
OspA
*Fig. 1B*
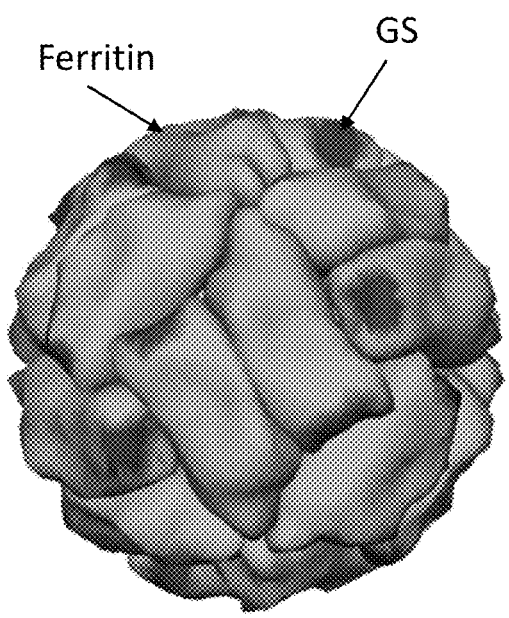
Ferritin
n = 24
*Fig. 1C*

OspA-Ferritin

| Serotype | Strain |
|---|---|
| 1 | *Borrelia burgdorferi* B31 |
| 2 | *Borrelia afzellii* Pko |
| 3 | *Borrelia garinii* PBr |
| 4 | *Borrelia bavariensis* Pbi |
| 5 | *Borrelia garinii* Phei |
| 7 | *Borrelia garinii* T25 |

OspA: YVLEGTLTA
S2  : FTLEGKVAN
S3  : FALEGTLTD
RD2 : YTLEGQLSD
Lfa1: YVIEGTSKQ

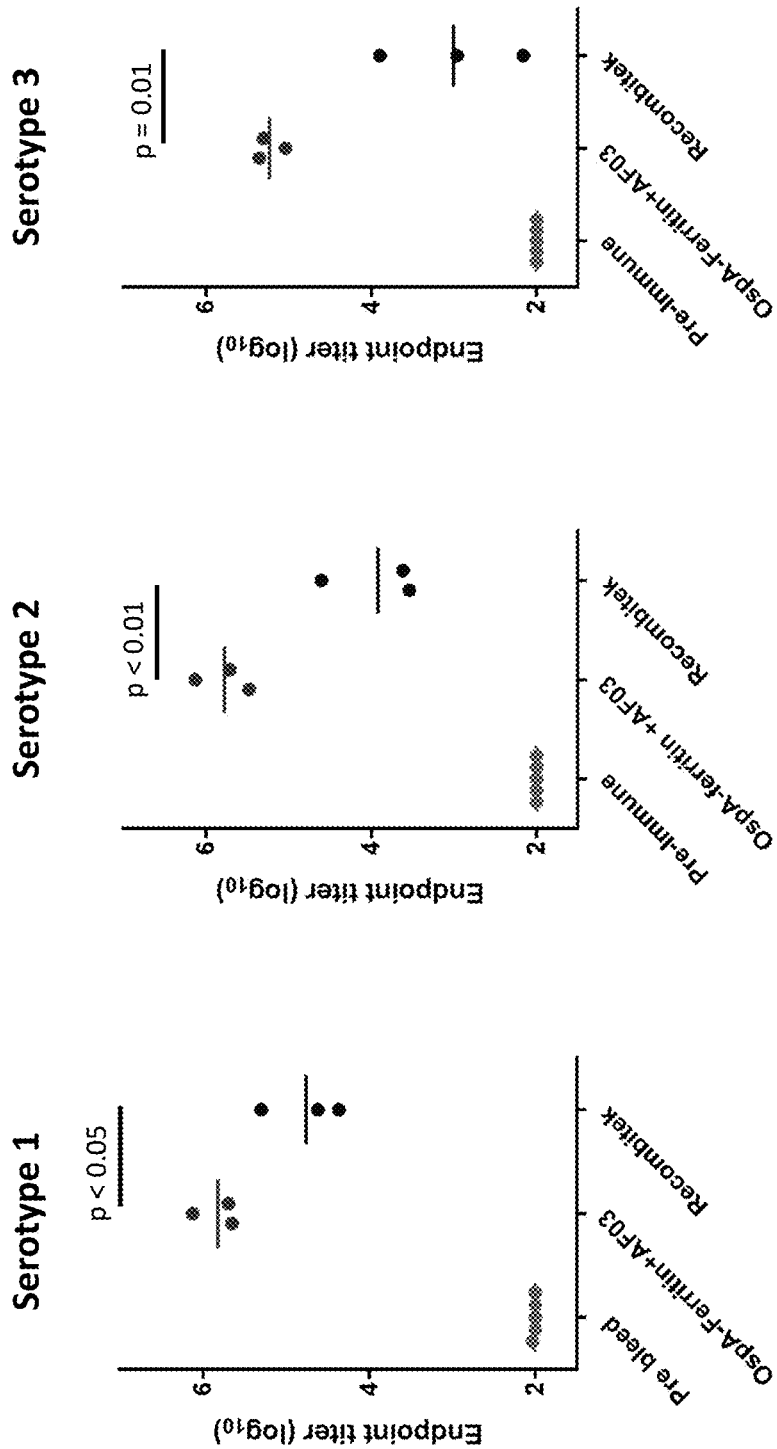

| Antigen | Mice/group | # mice culture positive | # mice infected (culture and PCR) | % infected | P value |
|---|---|---|---|---|---|
| Monovalent-3M-012 | 8 | 0 | 0 | 0 | P<0.0005 |
| Hexavalent-3M-012 | 8 | 0 | 1 | 12.5 | P<0.005 |
| Control particle | 9 | 6 | 7 | 77.8 | |

Fig. 11

GS  OspA-GS-Ferritin
GS1 OspA- GGGS-Ferritin
GS2 OspA- GGGSGGGS-Ferritin
GS5 OspA- GGGSGGGSGGGSGGGSGGGS-Ferritin

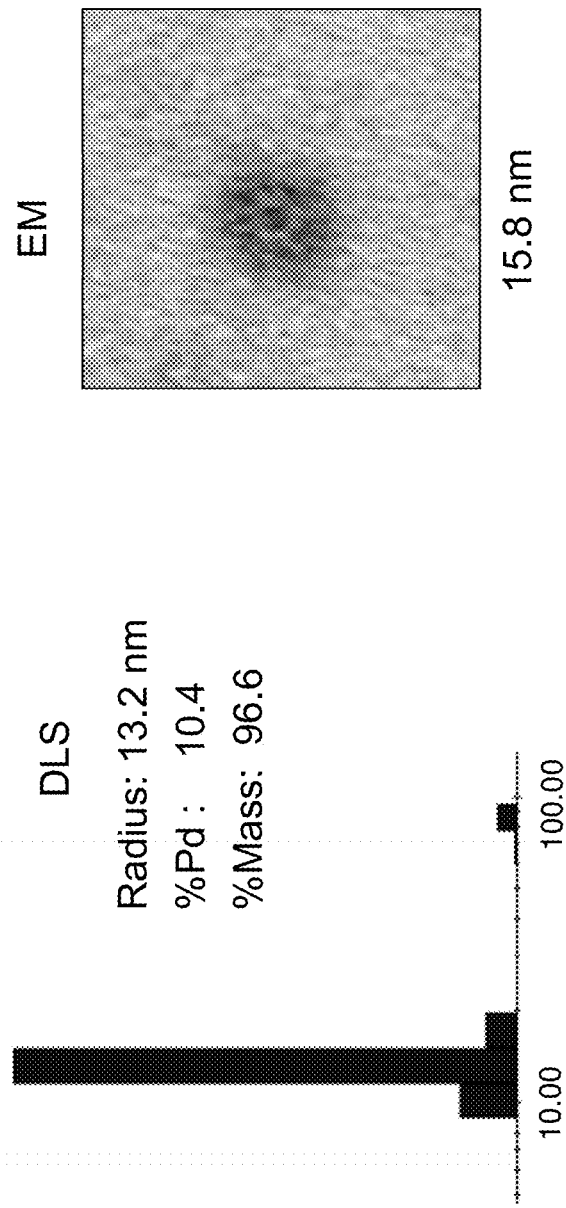

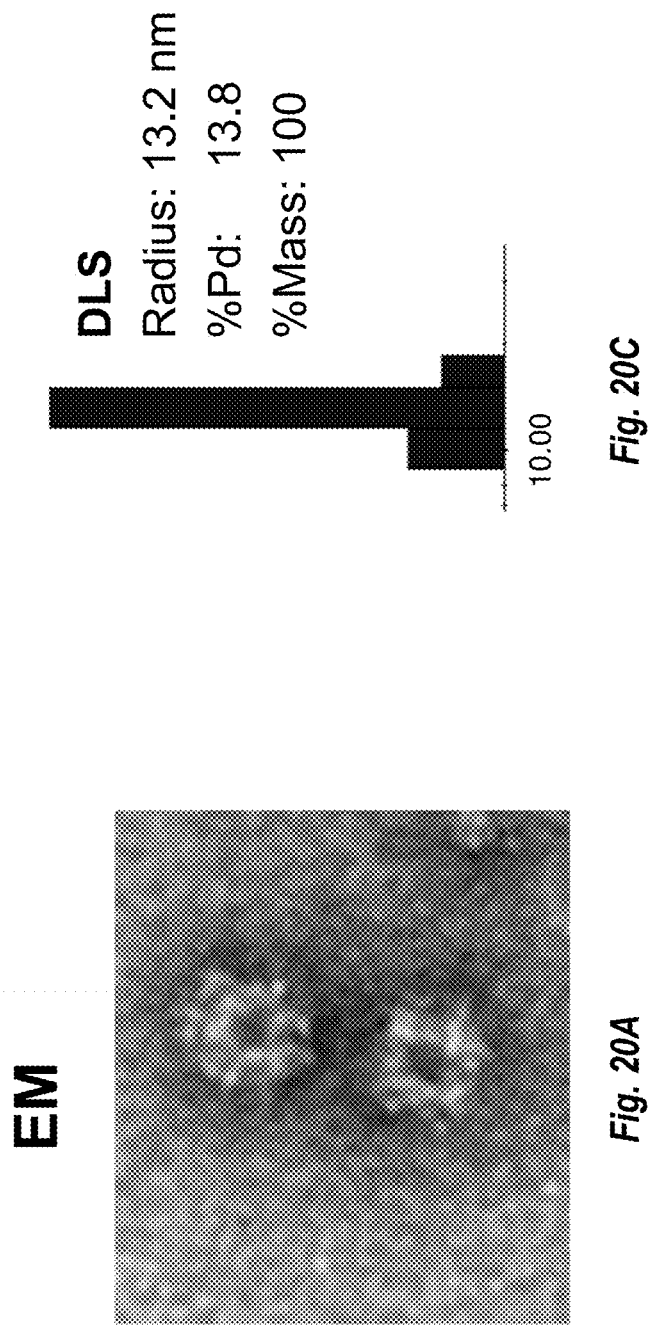

Fig. 26A

```
CA09 HA-Np     MATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNA
COBRA P1 HA-Np MVTGLRNIPSIQSRGLFGAIAGFIEGGWTGMIDGWYGYHHQNEQGSGYAADQKSTQNAINGITNKVNSVIEKMNTQFTAVGKEFNKLERMENLNKKVDDGFLDIWTYNA
COBRA X6 HA-Np MVTGLRNIPSIQSRGLFGAIAGFIEGGWTGMVDGWYGYHHQNEQGSGYAADQKSTQNAINGITNKVNSVIEKMNTQFTAVGKEFNKLERMENLNKKVDDGFLDIWTYNA
NC99 HA-Np     MVTGLRNIPQREIRGLFGAIAGFIEGGWTGMIDGWYGYHHQNEQGSGYAADQKSTQNAINGITNKVNSVIEKMNTQFTAVGKEFNKLERMENLNKKVDDGFLDIWTYNA
HK77 HA-Np     MVTGLRNIPSIQSRGLFGAIAGFIEGGWTGMIDGWYGYIHHQNEQGSGYAADQKSTQNAINGITNKVNSVIEKMNTQFTAVGKEFNKLERMENLNKKVDDGFLDIWTYNA
FM47 HA-Np     MVTGLRNIPSIQSRGLFGAIAGFIEGGWTGMIDGWYGYHHQNEQGSGYAADQKSTQNAINGIINKVNSVIEKMNTQFTAVGKEFNKLERMENLNKKVDDGFLDIWTYNA
DV57 HA-Np     MVTGLRNIPSQSRGLFGAIAGFIEGGWTGMNDGWYGYHHQNEQGSGYAADQKSTQNAINGITNKVNSVIEKMNTQFTAVGKEFNKLEKRMENLNKKVDDGFIDIWTYNA
MAL54 HA-Np    MVTGLRNIPSIQSRGLFGAIAGFIEGGWTGMVDGWYGYIHHQNEQGSGYAADQKSTQNAINGITNKVNSVIEKMNTQFTAVGKEFNKLERMENLNKKVDDGFLDIWTYNA

CA09 HA-Np     ELLVLLENERTLDFHDSNVKNLYEKVKSQLRNNAKEIGNGCFEFYHKCDNTCMESVKNGTYDYPKYSEEKLNREEIDS
COBRA P1 HA-Np ELLVLLENERTLDFHDSNVKNLYEKVKSQLRNNAKEIGNGCFEFYHKCDNECMESVKNGTYDYPKYSEESKLNREKIDS
COBRA X6 HA-Np ELLVLLENERTLDFHDSNVKNLYEKVKSQLRNNAKEIGNGCFEFYHKCNNECMESVKNGTYDYPKYSEESKLNREKIDS
NC99 HA-Np     ELLVLLENERTLDFHDSNVKNLYEKVKSQLRNNAKEIGNGCFEFYHKCNNECMESVKNGTYDYPKYSEESKLNREKIDS
HK77 HA-Np     ELLVLLENERTLDFHDSNVKNLYEKVKSQLRNNAKEIGNGCFEFYHKCNNECMESVKNGTYDYPKYSEESKLNREKIDS
FM47 HA-Np     ELLVLLENERTLDFHDSNVKNLYEKVANQLRNNAKEIGNGCFEFYHKCNNECMESVKNGTYDYPKYSEESKLNREKIDS
DV57 HA-Np     ELLVLLENERTLDFHDSNVKNLYEKVANQLRNNAKELGNGCFEFYHKCDNECMESVKNGTYDYPKYSEESKLNREKIDS
MAL54 HA-Np    ELLVLLENERTLDFHDSNVKNLYEKVKNQLRNNAKEIGNGCFEFYHKCDNECMESVKNGTYDYPKYSEESKLNRAKIDS
```

*Fig. 26A (cont.)*

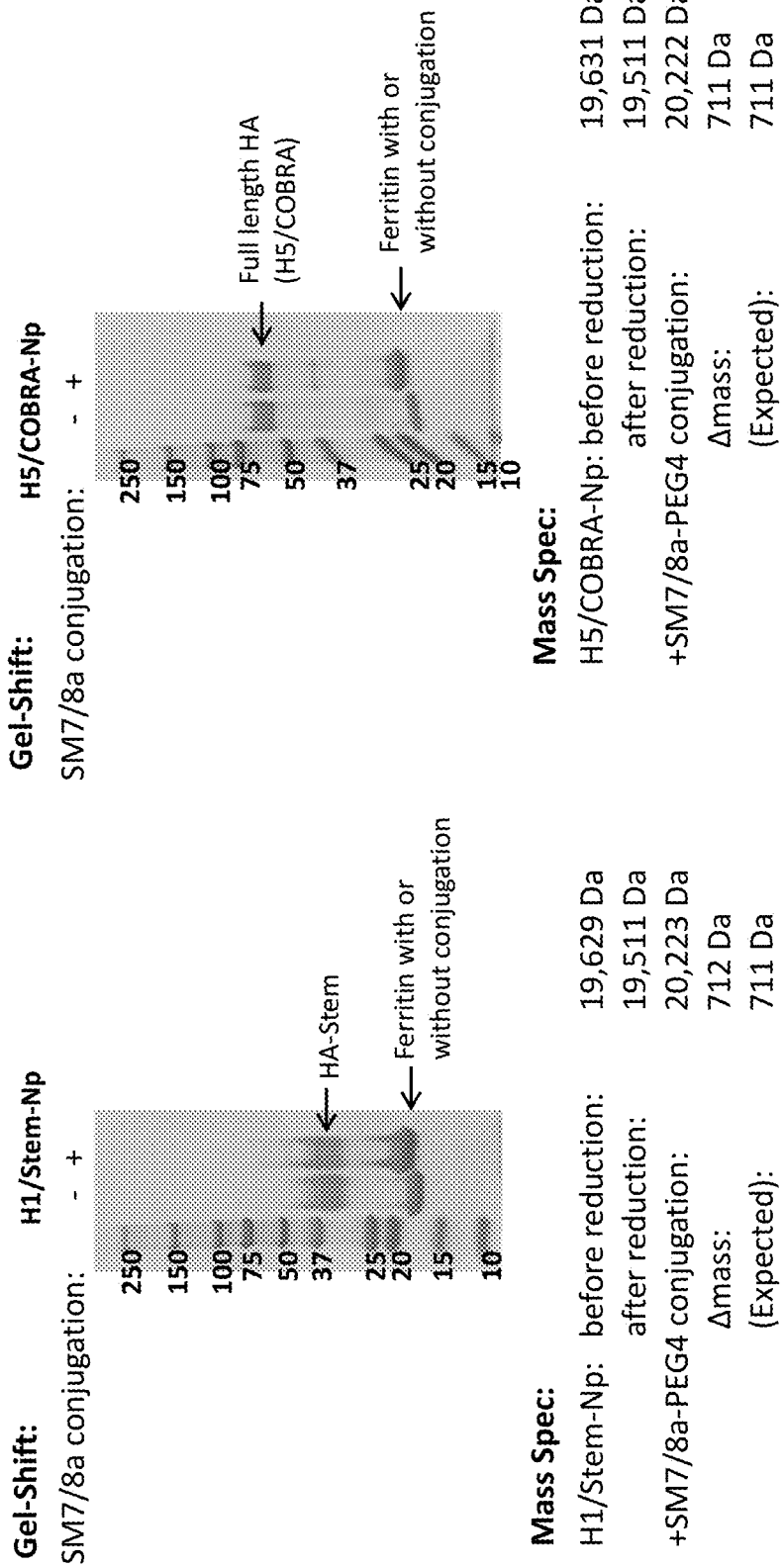

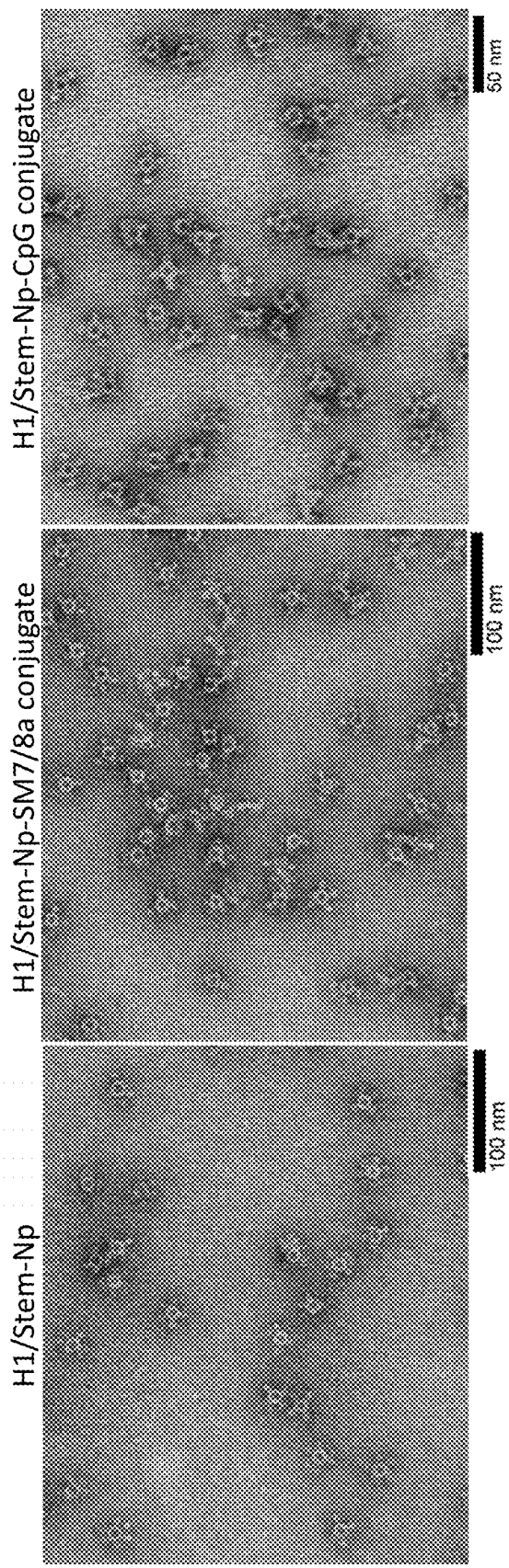

| Year | Nanoparticle | Size (nm) | Dispersity (%) |
|---|---|---|---|
| 1947 | FM47 HA-Np | 16.8 | 8.9 |
| 1954 | MAL54 HA-Np | 17.9 | 8.9 |
| 1957 | DV57 HA-Np | 17.7 | 6.2 |
| 1977 | HK77 HA-Np | 17.6 | 10.9 |
| 1999 | NC99 HA-Np | 17.3 | 8.6 |
| 2009 | CA09 HA-Np | 16.8 | 9.3 |
| 1999-2012 | COBRA X6 HA-Np | 17.5 | 5.1 |
| 1933-1957 + 2009-2011 and swine 1931-1998 | COBRA P1 HA-Np | 17.1 | 7 |

| # | Immunogens |
|---|---|
| 1 | NC99 HA-Np |
| 2 | CA09 HA-Np |
| 3 | FM47 HA-Np |
| 4 | HK77 HA-Np |
| 5 | MAL54 HA-Np |
| 6 | NC99 + CA09 HA-Nps |
| 7 | NC99 + CA09 + FM47 HA-Nps |
| 8 | NC99 + CA09 + HK77 HA-Nps |
| 9 | NC99 + CA09 + MAL54 HA-Nps |
| 10 | NC99 + CA09 + HK77 + FM47 HA-Nps |
| 11 | NC99 + CA09 + HK77 + MAL54 HA-Nps |
| 12 | NC99 + CA09 + FM47 + MAL54 HA-Nps |
| 13 | NC99 IIV |
| 14 | CA09 IIV |
| 15 | NC99 + CA09 IIV |

NC99 + CA09 HA-Nps

Ribi

Fig. 47A

NC99 + CA09 HA-Nps

Negative stain EM image of gL and gH nanoparticle

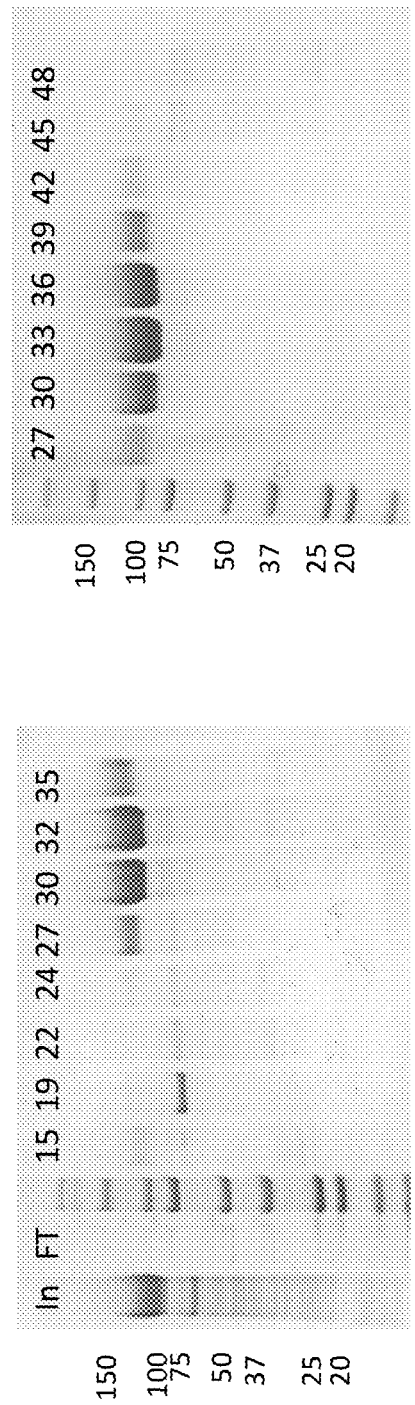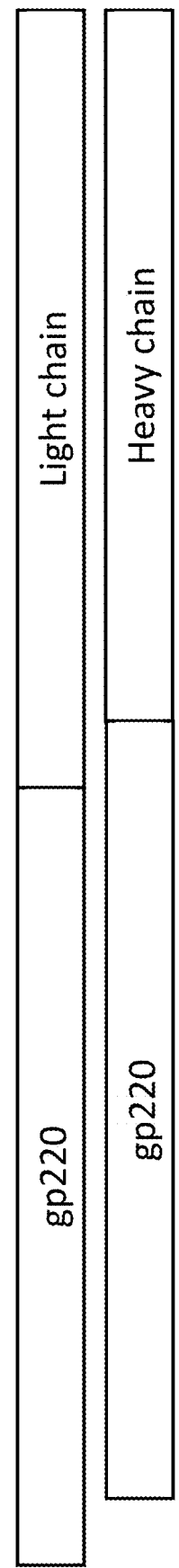
Fig. 75D
Fig. 75C
Fig. 75E

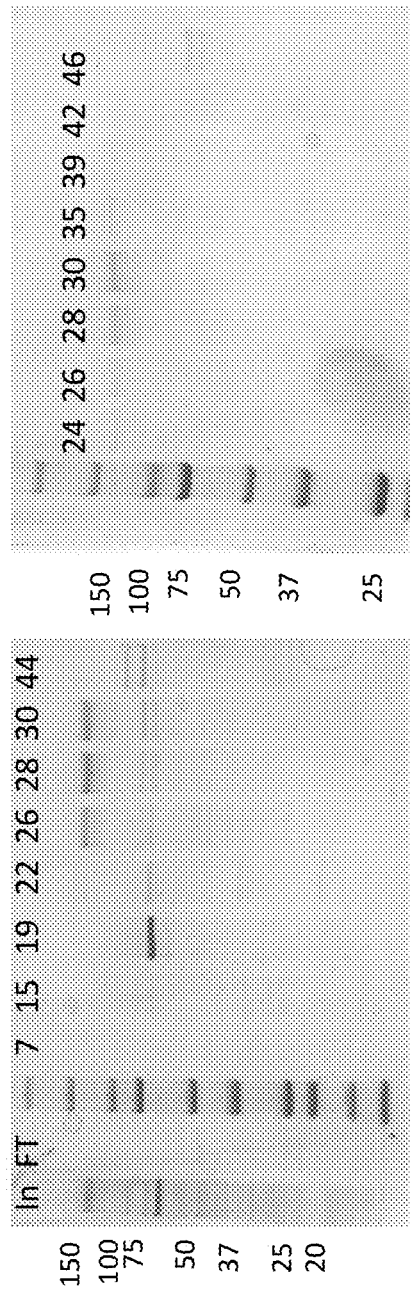
*Fig. 76C*
*Fig. 76D*
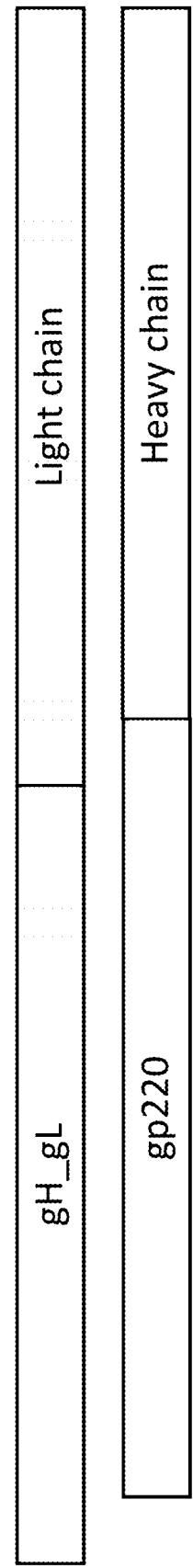
*Fig. 76E*

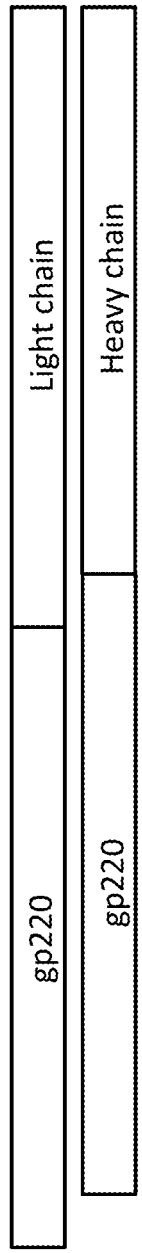
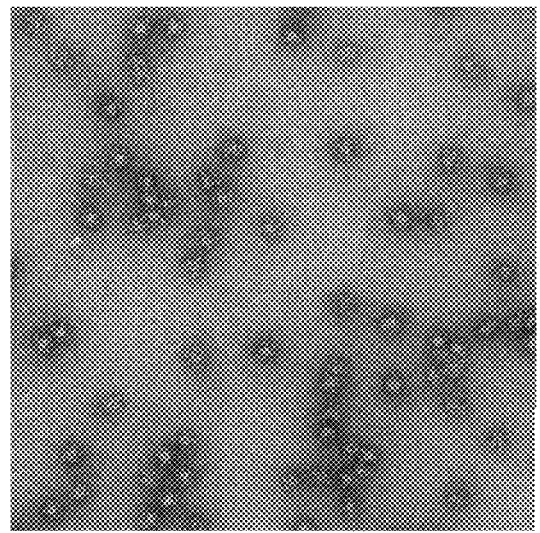
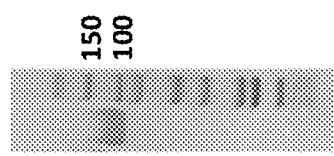
Fig. 77A
Fig. 77B
Fig. 77C

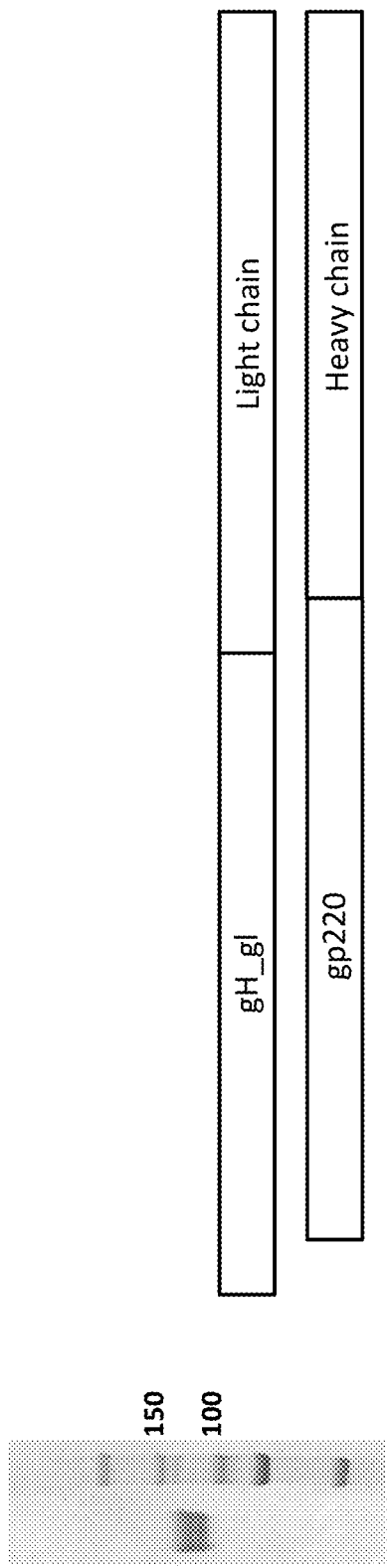
Fig. 77F
Fig. 77E
Fig. 77G

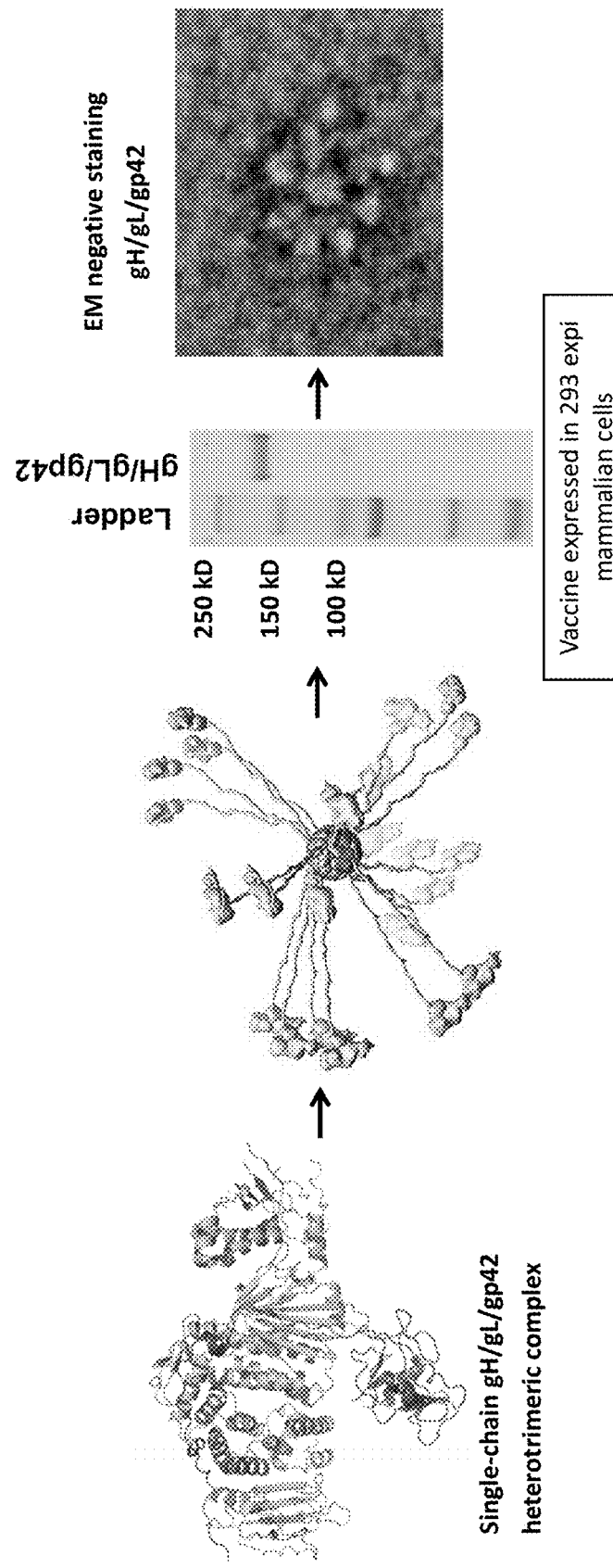
Fig. 86A
Fig. 86B
Fig. 86C
Fig. 86D
Fig. 86E

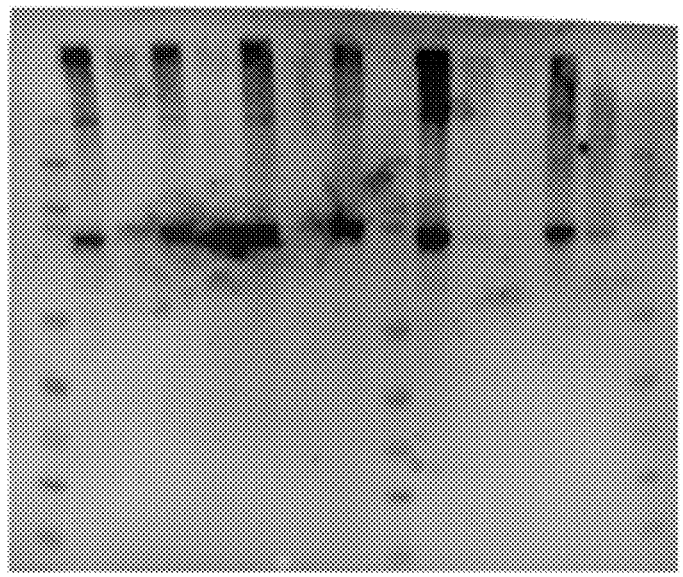

Lane 1 2 3 4 5 6 7 8 9 10 11 12 13 14 15

| Lane # | | Expression level in media |
|---|---|---|
| 1. | Ladder | |
| 2. | RF8090: NIH DS-CAV1 scF-bf-pFerr | Yes (Benchmark) |
| 3. | RF8100: Glycan addition T324N | Poor, reduced expression |
| 4. | RF8101 : Glycan addition E328N | Yes, improved expression |
| 5. | RF8102: Glycan addition K390T | Poor, reduced expression |
| 6. | RF8103: Glycan addition S348N | Yes, improved expression |
| 7. | RF8104: Glycan addition Y478S | No, reduced expression |
| 8. | RF8105: Glycan addition R507N | Yes, improved expression |
| 9. | Ladder | |
| 10. | RF8108: Proline addition I217P | Yes, improved expression |
| 11. | RF8109: Cavity filling Q224L | Poor, reduce expression |
| 12. | RF8110 : Cavity filling Q224L and Q225V | Poor, reduced expression |
| 13. | RF8111 : Cavity filling N228L | Yes, equal or increased expression |
| 14. | RF8112 : Cavity filling N228F | Poor, reduced expression |
| 15. | Ladder | |

*Fig. 88*

Anti-*Pre-fusion* F Antibody Response

Fig. 98A

Anti-*Post-fusion* F Antibody Response

Fig. 98B

Structural model of RSV G Peptide conjugated to Ferritin

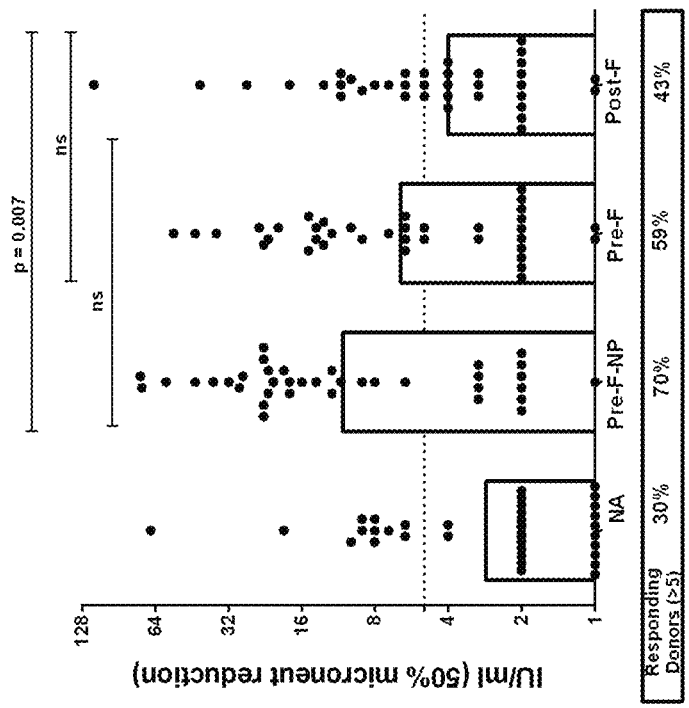
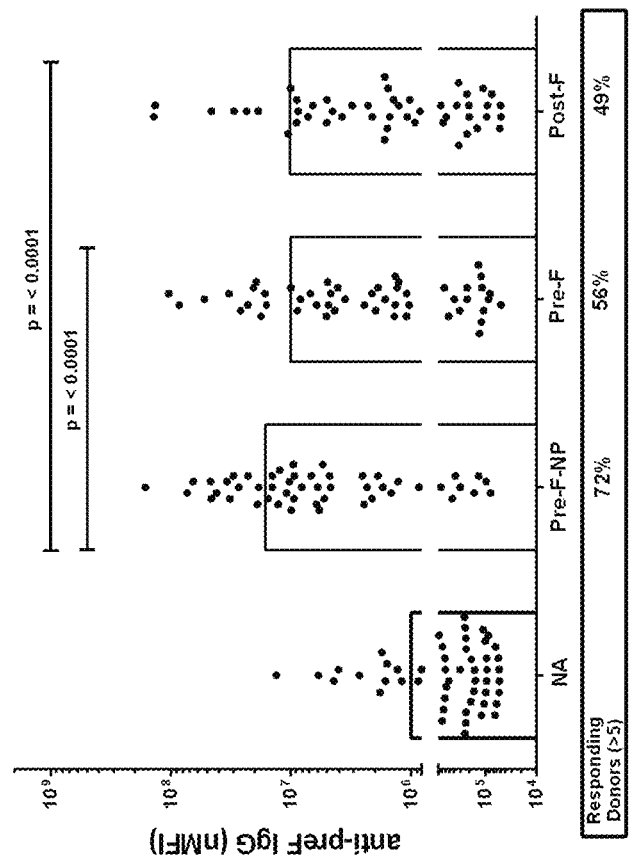
Fig. 106A
Fig. 106B

FERRITIN PROTEINS

This application is a continuation of International Application PCT/US2019/025422, filed Apr. 2, 2019, which claims the benefit of U.S. Provisional Patent Application No. 62/652,217, filed Apr. 3, 2018; U.S. Provisional Patent Application No. 62/652,199, filed Apr. 3, 2018; U.S. Provisional Patent Application No. 62/652,201, filed Apr. 3, 2018; U.S. Provisional Patent Application No. 62/652,210, filed Apr. 3, 2018; and U.S. Provisional Patent Application No. 62/652,204, filed Apr. 3, 2018, the entire contents of each of which are incorporated herein by reference.

The instant application contains a Sequence Listing which has been submitted electronically in ASCII format and is hereby incorporated by reference in its entirety. Said ASCII copy, created on Sep. 29, 2020, is named 2020-09-29_01121-0035-00US_SL_ST25.txt and is 1,116,213 bytes in size.

Even with many successes in the field of vaccinology, new breakthroughs are needed to protect humans against many life-threatening infectious diseases. Many currently licensed vaccines rely on decade-old technologies to produce live-attenuated or inactivated killed pathogens, which carry inherent safety concerns and in many cases, stimulate only short-lived, weak immune responses that require the administration of multiple doses. While advances in genetic and biochemical engineering have made it possible to develop therapeutic agents to challenging disease targets, these applications to the field of vaccinology have not been fully realized.

Recombinant protein technologies now allow the design of improved antigenic polypeptides. Additionally, nanoparticles have increasingly demonstrated the potential for effective antigen presentation and targeted drug delivery. Ferritin particles have been shown to have increased binding avidity afforded by the multivalent display of their molecular cargos, and an ability to cross biological barriers more efficiently due to their nanoscopic size. *Helicobacter pylori* (*H. pylori*) ferritin particles fused to influenza virus haemagglutinin (HA) protein have allowed improved antigen stability and increased immunogenicity in mouse influenza models (see Kanekiyo et al., Nature 499:102-106 (2013)). This fusion protein self-assembled into an octahedrally-symmetric nanoparticle and presented 8 trimeric HA spikes to give a robust immune response in various pre-clinical models when used with an adjuvant. However, these particles were not self-adjuvanting and it was unclear whether ferritin particles could be used as a suitable platform for polypeptides other than HA influenza, which may be less immunogenic than HA.

Here, a set of new polypeptides, nanoparticles, compositions, methods, and uses involving ferritin is presented. Described herein is a self-adjuvanting platform wherein immune-stimulatory moieties, such as adjuvants, were conjugated to ferritin via a surface-exposed amino acid or a linker between the ferritin and a non-ferritin polypeptide. Antigenic ferritin polypeptides were generated by combining non-ferritin polypeptides with the ferritin. The conjugation of an immune-stimulatory moiety to ferritin combined with the non-ferritin polypeptide allows for targeted co-delivery of the immune-stimulatory moiety and non-ferritin polypeptide in a single macromolecular entity, which can greatly decrease the potential for systemic toxicity that is feared with more traditional vaccines that comprise antigens and immune-stimulatory molecules such as adjuvants as separate molecules. The co-delivery of immune-stimulatory moieties together with non-ferritin polypeptides in a macromolecular entity and their multivalent presentation on ferritin particles may also reduce the overall dose of vaccine needed, reducing manufacturing burdens and costs. Also disclosed herein are antigenic ferritin polypeptides, nanoparticles, and compositions for use in immunizing against infection with Respiratory Syncytial virus (RSV), Epstein Barr virus (EBV), influenza, and Lyme disease.

Furthermore, polypeptides, nanoparticles, compositions, methods, and uses disclosed herein enable the co-delivery of a non-ferritin polypeptide from a pathogen and tailored immune signals that can elicit a specific type of immune response to match the desired immunological outcome against a specific pathogen. An example is the induction of Th1-type responses by TLR7/8 agonists conjugated to ferritin fused to hemagglutinin (HA), which leads to the production of IgG2a switched antibodies known to be more effective at engaging with FcγR to clear virus-infected cells by ADCC mechanisms (see DiLillo et al, Nature Medicine 20:143-151 (2014)). Further, co-delivery of the immune-stimulatory moieties conjugated to ferritin with the non-ferritin polypeptide in a single molecular entity can ensure that the stimulation of immune cells occurs in the presence of the non-ferritin polypeptide. In contrast, admixture of the same immune-stimulatory molecule without conjugation leads to systemic distribution, generally requiring higher doses, and also risking undesirable effects from indiscriminate immune stimulation in cells not contacted by antigen.

Also described herein is a platform in which multiple polypeptides are incorporated into a ferritin particle, e.g., by providing heavy and light ferritin chains comprising first and second non-ferritin polypeptides. This platform can provide a single macromolecular entity that is bivalent and has other advantages associated with ferritin therapeutics, such as, for example, conjugation of immune stimulatory moieties as described herein.

SUMMARY

It is an object of this disclosure to provide compositions, kits, methods, and uses that can provide one or more of the advantages discussed above, or at least provide the public with a useful choice. Accordingly, the following embodiments are disclosed herein.

Embodiment 1 is a ferritin protein comprising a mutation replacing a surface-exposed amino acid with a cysteine.

Embodiment 2 is a ferritin protein comprising an N- or C-terminal linker comprising a cysteine.

Embodiment 3 is ferritin protein comprising one or more immune-stimulatory moieties linked to the ferritin protein via a surface-exposed amino acid.

Embodiment 4 is any one of the preceding embodiments, which is an antigenic ferritin protein further comprising a non-ferritin polypeptide.

Embodiment 5 is an antigenic ferritin protein comprising (i) a mutation replacing a surface exposed amino acid with a cysteine and an immune-stimulatory moiety linked to the cysteine; and (ii) a non-ferritin polypeptide.

Embodiment 6 is an antigenic ferritin protein comprising (i) a surface-exposed cysteine, (ii) a peptide linker N-terminal to the ferritin protein, and (iii) a non-ferritin polypeptide N-terminal to the peptide linker.

Embodiment 7 is the ferritin protein of any one of the preceding embodiments, further comprising a mutation replacing a surface-exposed asparagine with a non-asparagine amino acid.

Embodiment 8 is the ferritin protein of any one of the preceding embodiments, further comprising a mutation replacing an internal cysteine with a non-cysteine amino acid.

Embodiment 9 is the ferritin protein of embodiment 8, wherein the internal cysteine is at position 31 of *H. pylori* ferritin, or a position that corresponds to position 31 of *H. pylori* ferritin as determined by pair-wise or structural alignment.

Embodiment 10 is an antigenic ferritin protein comprising:
a. a mutation replacing a surface exposed amino acid with a cysteine and an immune-stimulatory moiety linked to the cysteine;
b. a mutation replacing the internal cysteine at position 31 of *H. pylori* ferritin, or a mutation of an internal cysteine at a position that is analogous to position 31 of a non-*H. pylori* ferritin as determined by pair-wise or structural alignment, with a non-cysteine amino acid;
c. a mutation replacing a surface-exposed asparagine with a non-asparagine amino acid; and
d. a non-ferritin polypeptide.

Embodiment 11 is the ferritin protein of any one of embodiments 8-10, wherein the non-cysteine amino acid is serine.

Embodiment 12 is the ferritin protein of embodiments 7-11, wherein the asparagine is at position 19 of *H. pylori* ferritin, or an analogous position in a non-*H. pylori* ferritin as determined by pairwise or structural alignment.

Embodiment 13 is the ferritin protein of any one of the preceding embodiments, wherein the ferritin comprises one or more of E12C, S26C, S72C, A75C, K79C, S100C, and S111C mutations of *H. pylori* ferritin or one or more corresponding mutations in a non-*H. pylori* ferritin as determined by pairwise or structural alignment.

Embodiment 13a is the ferritin protein of embodiment 13, wherein the ferritin comprises an E12C mutation of *H. pylori* ferritin or a corresponding mutation in a non-*H. pylori* ferritin as determined by pairwise or structural alignment.

Embodiment 13b is the ferritin protein of embodiment 13, wherein the ferritin comprises an S26C mutation of *H. pylori* ferritin or a corresponding mutation in a non-*H. pylori* ferritin as determined by pairwise or structural alignment.

Embodiment 13c is the ferritin protein of embodiment 13, wherein the ferritin comprises an S72C mutation of *H. pylori* ferritin or a corresponding mutation in a non-*H. pylori* ferritin as determined by pairwise or structural alignment.

Embodiment 13d is the ferritin protein of embodiment 13, wherein the ferritin comprises an A75C mutation of *H. pylori* ferritin or a corresponding mutation in a non-*H. pylori* ferritin as determined by pairwise or structural alignment.

Embodiment 13e is the ferritin protein of embodiment 13, wherein the ferritin comprises a K79C mutation of *H. pylori* ferritin or a corresponding mutation in a non-*H. pylori* ferritin as determined by pairwise or structural alignment.

Embodiment 13f is the ferritin protein of embodiment 13, wherein the ferritin comprises an S100C mutation of *H. pylori* ferritin or a corresponding mutation in a non-*H. pylori* ferritin as determined by pairwise or structural alignment.

Embodiment 13g is the ferritin protein of embodiment 13, wherein the ferritin comprises an S111C mutation of *H. pylori* ferritin or a corresponding mutation in a non-*H. pylori* ferritin as determined by pairwise or structural alignment.

Embodiment 14 is the ferritin protein of any one of embodiments 4-13g, wherein the non-ferritin polypeptide is a polypeptide from influenza, Epstein Barr virus, Respiratory Syncytial virus (RSV), or *Borrelia*.

Embodiment 14a is the ferritin protein of any one of embodiments 4-13g, wherein the non-ferritin polypeptide comprises a polypeptide from influenza, optionally wherein the polypeptide comprises a hemagglutinin polypeptide.

Embodiment 14b is the ferritin protein of any one of embodiments 4-13g, wherein the non-ferritin polypeptide comprises a polypeptide from Epstein Barr virus, optionally wherein the polypeptide comprises one or more of a gL, gH, gL/gH, gp220, or gp42 polypeptide.

Embodiment 14c is the ferritin protein of any one of embodiments 4-13g, wherein the non-ferritin polypeptide comprises a polypeptide from Respiratory Syncytial virus, optionally wherein the polypeptide comprises an RSV F or RSV G polypeptide.

Embodiment 14d is the ferritin protein of any one of embodiments 4-13g, wherein the non-ferritin polypeptide comprises a polypeptide from *Borrelia*, optionally wherein the polypeptide comprises an OspA polypeptide.

Embodiment 15 is the ferritin protein of embodiment 14 or 14c, wherein the non-ferritin polypeptide comprises an RSV G polypeptide, optionally wherein the RSV G polypeptide comprises the G polypeptide central conserved region.

Embodiment 15a is the ferritin protein of embodiment 15, wherein the RSV G polypeptide is not glycosylated.

Embodiment 15b is the ferritin protein of embodiment 15 or 15a, wherein the RSV G polypeptide is chemically conjugated to the ferritin protein.

Embodiment 16 is the ferritin protein of any one of embodiments 4-5 or 7-15b, further comprising a peptide linker between the ferritin and non-ferritin polypeptide.

Embodiment 17 is the ferritin protein of any one of the preceding claims, comprising an immune-stimulatory moiety which is linked to the cysteine and comprises a moiety capable of hydrogen bonding or ionic bonding.

Embodiment 18 is the ferritin protein of any one of the preceding embodiments, comprising an immune-stimulatory moiety that is an agonist of TLR2, TLR7/8, TLR9, or STING.

Embodiment 18a is the ferritin protein of any one of the preceding embodiments, comprising an immune-stimulatory moiety that is an agonist of TLR2, optionally wherein the agonist is PAM2CSK4, FSL-1, or PAM3CSK4.

Embodiment 18b is the ferritin protein of any one of the preceding embodiments, comprising an immune-stimulatory moiety that is an agonist of TLR7/8, optionally wherein the agonist is a single-stranded RNA, an imidazoquinoline, a nucleoside analog, 3M-012, or SM 7/8a.

Embodiment 18c is the ferritin protein of any one of the preceding embodiments, comprising an immune-stimulatory moiety that is an agonist of TLR9, optionally wherein the agonist is a CpH oligodeoxynucleotide (ODN), an ODN comprising one or more 6mer CpG motif comprising 5' Purine (Pu)-Pyrimidine (Py)-C-G-Py-Pu 3', an ODN comprising the sequence of SEQ ID NO: 210, or ISS-1018.

Embodiment 18d is the ferritin protein of embodiment 18c, wherein the agonist of TLR9 comprises a backbone comprising phosphorothioate linkages.

Embodiment 18e is the ferritin protein of any one of the preceding embodiments, comprising an immune-stimulatory moiety that is an agonist of STING, optionally wherein the agonist is a cyclic dinucleotide (CDN), cdA, cdG, cAMP-cGMP, and 2'-5',3'-5' cGAMP, or DMXAA.

Embodiment 19 is the ferritin protein of any one of the preceding embodiments, comprising an amino acid sequence with 80%, 85%, 90%, 95%, 98%, or 99% identity to any one of SEQ ID NOs: 201-207 or 211-215.

Embodiment 19a is the ferritin protein of any one of the preceding embodiments, comprising an amino acid sequence with 80%, 85%, 90%, 95%, 98%, or 99% identity to SEQ ID NO: 201.

Embodiment 19b is the ferritin protein of any one of the preceding embodiments, comprising an amino acid sequence with 80%, 85%, 90%, 95%, 98%, or 99% identity to SEQ ID NO: 202.

Embodiment 19c is the ferritin protein of any one of the preceding embodiments, comprising an amino acid sequence with 80%, 85%, 90%, 95%, 98%, or 99% identity to SEQ ID NO: 203.

Embodiment 19d is the ferritin protein of any one of the preceding embodiments, comprising an amino acid sequence with 80%, 85%, 90%, 95%, 98%, or 99% identity to SEQ ID NO: 201-207 or 211-215.

Embodiment 19e is the ferritin protein of any one of the preceding embodiments, comprising an amino acid sequence with 80%, 85%, 90%, 95%, 98%, or 99% identity to SEQ ID NO: 204.

Embodiment 19f is the ferritin protein of any one of the preceding embodiments, comprising an amino acid sequence with 80%, 85%, 90%, 95%, 98%, or 99% identity to SEQ ID NO: 205.

Embodiment 19g is the ferritin protein of any one of the preceding embodiments, comprising an amino acid sequence with 80%, 85%, 90%, 95%, 98%, or 99% identity to SEQ ID NO: 206.

Embodiment 19h is the ferritin protein of any one of the preceding embodiments, comprising an amino acid sequence with 80%, 85%, 90%, 95%, 98%, or 99% identity to SEQ ID NO: 207.

Embodiment 19i is the ferritin protein of any one of the preceding embodiments, comprising an amino acid sequence with 80%, 85%, 90%, 95%, 98%, or 99% identity to SEQ ID NO: 211.

Embodiment 19j is the ferritin protein of any one of the preceding embodiments, comprising an amino acid sequence with 80%, 85%, 90%, 95%, 98%, or 99% identity to SEQ ID NO: 212.

Embodiment 19k is the ferritin protein of any one of the preceding embodiments, comprising an amino acid sequence with 80%, 85%, 90%, 95%, 98%, or 99% identity to SEQ ID NO: 213.

Embodiment 19l is the ferritin protein of any one of the preceding embodiments, comprising an amino acid sequence with 80%, 85%, 90%, 95%, 98%, or 99% identity to SEQ ID NO: 214.

Embodiment 19m is the ferritin protein of any one of the preceding embodiments, comprising an amino acid sequence with 80%, 85%, 90%, 95%, 98%, or 99% identity to SEQ ID NO: 215.

Embodiment 20 is a ferritin particle comprising the ferritin protein of any one of the preceding embodiments.

Embodiment 21 is a composition comprising the ferritin protein or ferritin particle of any one of the preceding embodiments and a pharmaceutically acceptable carrier.

Embodiment 22 is a composition comprising a first ferritin protein and a second ferritin protein, wherein the first ferritin protein comprises a ferritin heavy chain and a first non-ferritin polypeptide, the second ferritin protein comprises a ferritin light chain and a second non-ferritin polypeptide, and the first and second non-ferritin polypeptides are different, optionally wherein a ferritin particle comprises the first ferritin protein and the second ferritin protein.

Embodiment 23 is the composition of embodiment 21 or 22, further comprising an adjuvant.

Embodiment 24 is the ferritin protein, ferritin particle, or composition of any one of embodiments 4-23, for use in vaccinating a subject.

Embodiment 25 is a method of vaccinating a subject comprising administering the ferritin protein, ferritin particle, or composition of any one of embodiments 4-23 to a subject.

Embodiment 26 is the ferritin protein, ferritin particle, or composition of embodiment 24 or the method of embodiment 25, wherein the subject is human.

Embodiment 26a is the ferritin protein, ferritin particle, or composition of embodiment 24 or the method of embodiment 25, wherein the subject is a mammal, optionally wherein the mammal is a primate or domesticated mammal, further optionally wherein the primate is a non-human primate, monkey, macaque, rhesus or cynomolgus macaque, or ape, or the domesticated mammal is a dog, rabbit, cat, horse, sheep, cow, goat, camel, or donkey.

Embodiment 27 is a nucleic acid encoding the ferritin protein of any one of embodiments 1-26a, optionally wherein the nucleic acid is an mRNA.

Embodiment F1 is an antigenic influenza-ferritin polypeptide comprising (i) a ferritin protein comprising a mutation replacing a surface-exposed amino acid with a cysteine, and (ii) an influenza polypeptide.

Embodiment F2 is an antigenic influenza-ferritin polypeptide comprising (i) a ferritin protein comprising a mutation replacing a surface-exposed amino acid with a cysteine and an immune-stimulatory moiety conjugated to the cysteine; and (ii) an influenza polypeptide.

Embodiment F3 is the antigenic influenza-ferritin polypeptide of embodiment F1, further comprising an immune-stimulatory moiety conjugated to the ferritin protein via the cysteine.

Embodiment F4 is the antigenic influenza-ferritin polypeptide of any one of embodiments F1-F3, wherein the influenza polypeptide comprises a hemagglutinin (HA) or neuraminidase (NA) polypeptide.

Embodiment F5 is the antigenic influenza-ferritin polypeptide of embodiment F4, wherein the HA polypeptide comprises a conserved region.

Embodiment F6 is the antigenic influenza-ferritin polypeptide of embodiment F5, wherein the conserved region comprises all or part of the stem region of the HA.

Embodiment F7 is the antigenic influenza-ferritin polypeptide of any one of embodiments F1-F6, wherein the influenza antigen comprises an HA antigen comprising a Y98F mutation.

Embodiment F8 is the antigenic influenza-ferritin polypeptide of any one of embodiments F1-F7, further comprising a mutation replacing an internal cysteine with a non-cysteine amino acid.

Embodiment F9 is the antigenic influenza-ferritin polypeptide of embodiment F8, wherein the internal cysteine is at position 31 of *H. pylori* ferritin, or a position that corresponds to position 31 of *H. pylori* ferritin as determined by pair-wise or structural alignment, optionally wherein the internal cysteine is mutated to serine.

Embodiment F10 is the antigenic influenza-ferritin polypeptide of any one of embodiments F1-F9, further comprising a mutation replacing a surface-exposed asparagine with a non-asparagine amino acid, optionally wherein the non-asparagine amino acid is glutamine.

Embodiment F11 is the antigenic influenza-ferritin polypeptide of any one of embodiments F1-F10, wherein the surface exposed amino acid is a mutation of E12, S26, S72, A75, K79, S100, or S111 of *H. pylori* ferritin or an analogous amino acid in a non-*H. pylori* ferritin as determined by pair-wise or structural alignment.

Embodiment F12 is the antigenic influenza-ferritin polypeptide of embodiment F11, wherein the mutation at the surface exposed amino acid is E12C, S26C, S72C, A75C, K79C, S100C, or S111C of *H. pylori* ferritin or an analogous amino acid in a non-*H. pylori* ferritin as determined by pair-wise or structural alignment.

Embodiment F13 is the antigenic influenza-ferritin polypeptide of any one of embodiments F1-F12, wherein the immune-stimulatory moiety is an agonist of TLR7 or TLR8.

Embodiment F14 is the antigenic influenza-ferritin polypeptide of any one of embodiments F1-F13, wherein the immune-stimulatory moiety is an agonist of TLR9.

Embodiment F15 is the antigenic influenza-ferritin polypeptide of any one of embodiments F1 or F3-F14, further comprising a linker between the immune-stimulatory moiety and the ferritin protein.

Embodiment F16 is the antigenic influenza-ferritin polypeptide of embodiment F15, wherein the linker comprises one, two, or three of a maleimide moiety, a polyethylene glycol (PEG) moiety, and a dibenzocyclooctyne (DBCO) moiety.

Embodiment F17 is the antigenic influenza-ferritin polypeptide of any one of embodiments F1-F16, further comprising a peptide linker between the ferritin protein and the influenza polypeptide.

Embodiment F18 is a ferritin particle comprising the antigenic influenza-ferritin polypeptide of any one of embodiments F1-F17.

Embodiment F19 is a composition comprising the antigenic influenza-ferritin polypeptide or ferritin particle of any one of embodiments F1-F18 and a pharmaceutically acceptable carrier.

Embodiment F20 is the composition of embodiment F19, which further comprises a second antigenic influenza-ferritin polypeptide comprising a ferritin protein and a different influenza polypeptide.

Embodiment F21 is the composition of embodiment F20, wherein the influenza polypeptide is from influenza type A and the influenza polypeptide of the second antigenic influenza-ferritin polypeptide is from influenza type B, or wherein the influenza polypeptide and the influenza polypeptide of the second influenza-ferritin polypeptide are from subtype H1, H2, H3, H4, H5, H6, H7, H8, H9, H10, H11, H12, H13, H14, H15, H16, H17, or H18, or wherein one or both of the influenza polypeptides comprise engineered stabilized stem antigens from subtypes H1, H3, H7 or H10.

Embodiment F22 is the antigenic influenza-ferritin polypeptide, ferritin particle, or composition of any one of embodiments F1-F21 for use in a method of eliciting an immune response to influenza or in protecting a subject against infection with influenza.

Embodiment F23 is a method of eliciting an immune response to influenza or protecting a subject against infection with influenza comprising administering any one or more antigenic influenza-ferritin polypeptide, ferritin particle, or composition of any one of embodiments F1-F22 to a subject.

Embodiment F24 is the antigenic influenza-ferritin polypeptide, ferritin particle, composition, or method of any one of embodiments F1-F23, wherein the subject is human.

Embodiment F25 is a nucleic acid encoding the antigenic influenza-ferritin polypeptide of any one of embodiments F1-F17, optionally wherein the nucleic acid is an mRNA.

Additional objects and advantages will be set forth in part in the description which follows, and in part will be obvious from the description, or may be learned by practice. The objects and advantages will be realized and attained by means of the elements and combinations particularly pointed out in the appended claims.

It is to be understood that both the foregoing general description and the following detailed description are exemplary and explanatory only and are not restrictive of the claims.

The accompanying drawings, which are incorporated in and constitute a part of this specification, illustrate several embodiments and together with the description, serve to explain the principles described herein.

BRIEF DESCRIPTION OF THE DRAWINGS

FIGS. 1A-1D show exemplary designs of OspA-Ferritin nanoparticles. FIG. 1A. OspA genetically fused to ferritin to form a fusion protein. The OspA and ferritin sequences are separated by a glycine-serine linker (-GS-). FIG. 1B. A structure of the ectodomain of OspA is depicted. The C-terminus where OspA is attached to ferritin is indicated with an asterisk. FIG. 1C. An exemplary ferritin nanoparticle composed of 24 monomers of *H. pylori* ferritin. FIG. 1D. An exemplary OspA-ferritin fusion protein nanoparticle. Ferritin (light gray), the location of the glycine-serine linker (GS), and OspA (dark gray and black) are depicted (n: number of subunits).

FIG. 2A. Size exclusion chromatography (SEC) profile of an exemplary OspA-Ferritin nanoparticle purified on a Superose 6 column. FIG. 2B. SDS-PAGE gel of a purified exemplary OspA-Ferritin from Expi293 cells. FIG. 2C. Dynamic Light Scattering (DLS) profile of exemplary OspA-Ferritin nanoparticles. Radius is 13 nm, % Pd (measure of normalized polydispersity) is 7.4, and mass is 100%. FIG. 2D. Composite image of an exemplary OspA-Ferritin constructed from class averaging of transmission electron micrographs of 318 particles at 67,000× magnification. Ferritin nanoparticles appear on transmission electron microscopy as a strong circular density with a hollow center. Each nanoparticle is surrounded by numerous, short shapes corresponding to OspA that appear circular or slightly oblong.

FIG. 3A. Biochemical analysis by SDS-PAGE of OspA-Ferritin Serotypes 1-5 and 7 purified by size exclusion chromatography. FIG. 3B. Transmission electron microscopy of OspA-Ferritin Serotypes 1-5 and 7 (98,000×).

FIG. 5A. Structure showing the location of the LFA-1 homology site (amino acids 165-173 of SEQ ID NO: 83) within an OspA ectodomain.

FIG. 5B. Dendrogram showing the relationship of OspA amino acids 165-173 of SEQ ID NO: 83 (*B. burgdorferi* Serotype 1 OspA) to corresponding sequences in hLFA-1 and other *Borrelia* species and serotypes. FIG. 5C. The nine-amino-acid segment (nonapeptide) at amino acids 165-173 of SEQ ID NO: 83 (labeled "OspA") is compared with the corresponding

FIG. 15A. Coomassie staining of purified OspA constructs comprising linkers as indicated. FIG. 15A discloses SEQ ID NOS 443-445, respectively, in order of appearance. FIG. 15B. Dynamic Light Scattering (DLS) of OspA-ferritin nanoparticle comprising GS1 (SEQ ID NO: 60). FIG. 15C. DLS of OspA-ferritin nanoparticle comprising GS2 (SEQ ID NO: 61). FIG. 15D. Electron micrograph (EM) of OspA-ferritin nanoparticle comprising GS5 (SEQ ID NO: 62). FIG. 15E. DLS of OspA-ferritin nanoparticle comprising GS5 (SEQ ID NO: 62).

FIGS. 17A-17C show characterization of a lumazine synthase OspA serotype 4 construct (SEQ ID NO: 18). FIG. 17A. DLS data. FIG. 17B. Coomassie gel of indicated fractions 22-64 of size exclusion chromatography (SEC) trace. FIG. 17C. EM data.

FIG. 19A. EM data. FIG. 19B. Coomassie gel of indicated fractions 20-40 of the SEC trace. FIG. 19C. DLS data.

FIGS. 20A-20C show characterization of a OspA serotype 2-lumazine synthase construct (SEQ ID NO: 16). FIG. 20A. EM data. FIG. 20B. Coomassie gel of indicated fractions 27-56 of the SEC trace. FIG. 20C. DLS data.

FIG. 21A. Coomassie gel of indicated fractions 23-39 of the SEC trace. FIG. 21B. DLS data.

FIG. 22A. EM data. FIG. 22B. Coomassie gel of indicated fractions 22-38 of the SEC trace. FIG. 22C. DLS data.

FIG. 23A. EM data. FIG. 23B. Coomassie gel of indicated fractions 20-38 of the SEC trace. FIG. 23C. DLS data.

FIGS. 26A-26B. Sequence comparison and homology of representative H1N1 influenza virus strains. (FIG. 26A) Sequence alignment of candidate antigenic HA polypeptides using vector NTI AlignX software. Black on white: consensus residue derived from a completely conserved residue at a given position. White on black: consensus residue derived from the occurrence of greater than 50% of a single residue at a given position. Black on white underlined and bold: residue weakly similar to consensus residue at given position. Black on white with double underline and italics: consensus residue derived from a block of similar residues at a given position. Black on white bold: non-similar residues. Sequences shown are the HA portions of the following sequences plus the serine of a linker at the C-terminus: CA09 HA-Np=residues 1-519 of SEQ ID NO: 315. COBRA P1 HA-Np=residues 1-519 of SEQ ID NO: 327. COBRA X6 HA-Np=residues 1-518 of SEQ ID NO: 329. NC99 HA-Np=residues 1-518 of SEQ ID NO: 301. HK77 HA-Np=residues 1-519 of SEQ ID NO: 318. FM47 HA-Np=residues 1-519 of SEQ ID NO: 317. DV57 HA-Np=residues 1-518 of SEQ ID NO: 321. MAL54 HA-Np=residues 1-519 of SEQ ID NO: 316. (FIG. 26B) A dendrogram generated with the Neighbor Joining Method (Vector NTI) for the HA protein sequences from the listed influenza strains. Arrows indicate strains selected as candidates for evaluation by generating HA-ferritin nanoparticles from these sequences and testing their immunogenicity in mice.

(FIG. 28A) The result of conjugation of SM7/8a small molecule to a cysteine resulting from a mutation replacing a surface-exposed amino acid in ferritin via a PEG4 linker harboring a maleimide reactive group is illustrated in the context of a ferritin nanoparticle. (FIG. 28B) The result of conjugation of CpG (SEQ ID NO: 535) to a cysteine resulting from a mutation replacing a surface-exposed amino acid in ferritin is illustrated in the context of a ferritin nanoparticle using 2-step click chemistry, with a maleimide-DBCO bifunctional linker and azide-functionalized CpG reagent.

(FIG. 29A) Model of a ferritin nanoparticle comprising an HA polypeptide and 3M-012 conjugated to a surface-exposed cysteine of ferritin using a 2-step click chemistry reaction via a maleimide-DBCO bifunctional linker and Azide-functionalized 3M-012 reagent. (FIG. 29B) Model of a ferritin nanoparticle comprising an HA polypeptide and CpG conjugated to a surface-exposed cysteine of ferritin using a 2-step click chemistry reaction, with a maleimide-DBCO bifunctional linker and Azide-functionalized CpG reagent. FIG. 29B discloses SEQ ID NO: 534.

FIGS. 31A and 31B. Gel-shift and mass spectrometry (MS) results with or without conjugation. (FIG. 31A) Gel-shift and mass spectrometry results for H1/Stem-Np (SEQ ID NO: 343) in the presence (+) or absence (−) of conjugation to maleimide-PEG4-SM7/8a. (FIG. 31B) Gel-shift and mass spectrometry results for H5/hCobra2-Np (SEQ ID NO: 332) in the presence (+) or absence (−) of conjugation to maleimide-PEG4-SM7/8a.

(FIG. 32A) Gel-shift results for H1/Stem-Np following peptide N-glycosidase (PNGase) treatment with or without conjugation to either maleimide-PEG4-SM7/8a or by 2-step click chemistry with maleimide-PEG4-DBCO and Azide-CpG. (FIG. 32B) Gel-shift results for H1/Stem-Np following trypsin treatment with or without conjugation to either maleimide-PEG4-SM7/8a or maleimide-PEG4-DBCO and Azide-CpG by 2-step click chemistry.

(FIG. 33A) MS data after treatment with PNGase shows the mass of H1/Stem-Np before and after conjugation to maleimide-PEG4-SM7/8a. (FIG. 33B) MS data after treatment of H1/Stem-Np with trypsin shows the mass of the cleaved ferritin before and after conjugation to maleimide-PEG4-SM7/8a.

(FIG. 37A) H1/Stem-Np comprising S111C before reduction. (FIG. 37B) H1/Stem-Np comprising S111C after reduction. The decrease in mass (115 Da) observed after reduction is consistent with the removal of a post-translational modification that inhibits the reactivity of cysteine. (FIG. 37C) Mass spectra of NC99 HA-TEV-Np-S26C nanoparticle (SEQ ID NO: 310) with and without conjugation to 3M012. (FIG. 37D) Mass spectra of NC99 HA-TEV-Np-A75C nanoparticle (SEQ ID NO: 312) with and without conjugation to 3M012. (FIG. 37E) Mass spectra of NC99 HA-TEV-Np-S111C nanoparticle (SEQ ID NO: 309) with and without conjugation to 3M012.

FIGS. 38A-38F. Negative stain electron microscopy (EM) images of nanoparticles of H1/Stem-Np or NC99 HA-Np with and without conjugation to SM7/8a, 3M012, or CpG. (FIG. 38A) Unconjugated H1/Stem-Np. (FIG. 38B) H1/Stem-Np-SM7/8a conjugate. (FIG. 38C) H1/Stem-Np-CpG conjugate. (FIG. 38D) NC99 HA-Np (SEQ ID NO: 309)]. (FIG. 38E) NC99 HA-Np-3M012 conjugate. (FIG. 38F). NC99 HA-Np-CpG conjugate.

FIG. 40A shows ELISA to H1/New Caledonia/ 20/1999 HA trimers. PAA=polyacrylic acid; mixed equimolar=83.3 ng SM7/8a (equivalent to the dose administered with the SM7/8 conjugated ferritin nanoparticles); high dose=21.84 μg (higher than the dose administered with the SM7/8 conjugated ferritin nanoparticles). FIG. 40B shows ELISA to H1/Stem trimers. Mixed equimolar=850 ng of CpG (equivalent to the dose administered with the CpG conjugated ferritin nanoparticles); high dose=20 μg of CpG.

FIGS. 43A-43C. Characterization of self-assembling HA-ferritin nanoparticles derived from six evolutionarily divergent H1 hemagglutinin (HA) antigens and two computationally generated (COBRA) antigens. (FIG. 43A) Nanoparticle size and polydispersity ("Dispersity") were measured by dynamic light scattering (DLS). (FIG. 43B) Purity of HA-nanoparticles was assessed by SDS-PAGE Coomassie staining. (FIG. 43C) Nanoparticle integrity was visualized by negative stain electron microscopy at 80,000× magnification. FM47=A/Fort Monmouth/1-JY2/1947; MAL54=A/Malaysia/302/1954; DV57=A/Denver/1957 (DV57); HK77=A/Hong Kong/117/1977; NC99=A/New Caledonia/20/99; CA09=A/California/4/2009. COBRA P1 and COBRA X6 are computationally generated consensus from multiple sequences, described recently by Carter D M, et al., J Virol 90:4720-4734 (2016). See legend for FIGS. 26A-B for SEQ ID NOs.

(FIGS. 44A-44E) Data with Ribi adjuvant. (FIGS. 44F-44H) Data with AF03 adjuvant. The x-axis indicates the panel of H1N1 influenza strains tested by reference year, from 1934 to 2013. Table 2 gives the complete strain designation corresponding to each year. Asterisks indicate matched strains.

(FIG. 45A) Mice [n=5] were immunized with the specified nanoparticles or combinations of nanoparticles using Sigma Adjuvant System (catalog #S6322). IIV refers to Influenza Inactivated Vaccine. (FIGS. 45B-F) Antibody response was measured by determining ELISA titers to HA timers from A/Fort Monmouth/1/1947 (FIG. 45B); A/Malaysia/302/1954 (FIG. 45C); A/Hong Kong/117/1977 (FIG. 45D); A/New Caledonia/20/99 (FIG. 45E); or A/California/4/2009 (FIG. 45F). ELISA titers were measured 5 weeks after the first immunization. The lowest serum dilution tested sets the assay limit of detection as indicated by the dotted line. Open circles indicate a match between the strain of origin of a nanoparticle administered to mice and the strain assayed by ELISA.

(FIGS. 46A-46B) Bivalent combinations. (FIGS. 46C-46E) Trivalent combinations. (FIGS. 46F-46H) Quadrivalent combinations. HAI titers ($\log_2$) for a panel of divergent H1N1 influenza viruses were assayed. Mice (n=5) were immunized with the indicated HA-nanoparticle combinations at weeks 0 and 3, with adjuvants. The bivalent combination COBRA X6+COBRA P1 HA-Nps was tested with AF03 adjuvant, for consistency with the evaluation of the monovalent COBRA HA-Np. Likewise, the combinations of individual strain HA-ferritin nanoparticles used Ribi adjuvant for consistency with the evaluation of the monovalent individual strain HA-Nps. Asterisks indicate a match between the strain of origin of a nanoparticle administered to the mice and the strain assayed by ELISA. The x-axes indicate the panel of H1N1 influenza strains tested by reference year, from 1934 to 2013. Table 2 gives the complete strain designation for each year. Dashed line indicates the assay limit of detection.

Figures 47A, 47B:
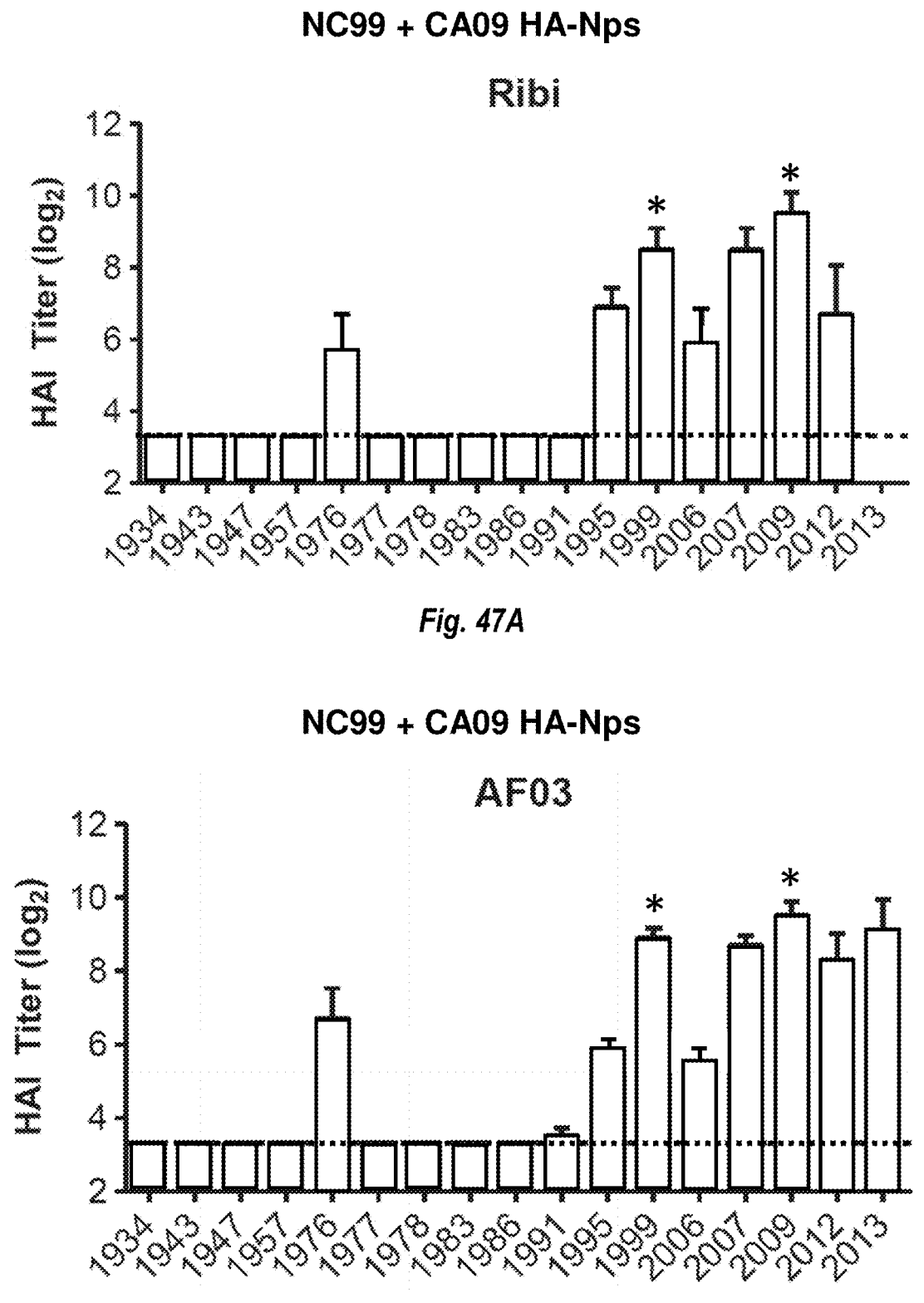

FIGS. 47A-47F. Antibody response to compositions with Ribi or AF03 adjuvants as measured by assays of HAI titers. The results obtained with Ribi adjuvant (FIGS. 47A, 47C, and 47E) compared to those obtained with AF03 adjuvant (FIGS. 47B, 47D, and 47F) are similar for a bivalent combination of NC99 and CA09 HA-Nps (FIGS. 47A-47B), a trivalent combination of NC99, CA09 and HK77 HA-Nps (FIGS. 47C-47D), and a trivalent combination of NC99, CA09 and FM47 HA-Nps (FIGS. 47E-47F). HAI titers were assayed in mouse serum 6 weeks after priming dose, with boost at week 3. Mice [n=5] were immunized with combinations of HA-Nps, as indicated, with either Ribi or AF03 adjuvants. Asterisks indicate a match between the strain of origin of a nanoparticle administered to mice and the strain assayed by ELISA. The x-axes indicate the panel of H1N1 influenza strains tested by reference year, from 1934 to 2013. Table 2 gives the complete strain designation for each year. Dashed line indicates the assay limit of detection.

(FIG. 48A) NC99 IIV. (FIG. 48B) CA09 IIV. (FIG. 48C) NC99+ CA09 IIV. Hemagglutination Inhibition (HAI) titers ($\log_2$) of sera from mice 6-weeks after immunization with the indicated IIV vaccines, as single components or co-administered, against a panel of divergent H1N1 influenza viruses. Mice (n=5) were immunized with 170 ng (HA content) of each vaccine at weeks 0 and 3, with Ribi adjuvant. The x-axis indicates the panel of H1N1 influenza strains tested by reference year, from 1934 to 2013 (see also Table 2). The x-axes indicate the panel of H1N1 influenza strains tested by reference year, from 1934 to 2013. Table 2 gives the complete strain designation for each year. Dashed line indicates the assay limit of detection.

FIG. 49A: PBS alone; FIG. 49B: A/California/2009 IIV; FIG. 49C: NC99+ CA09+HK77 HA-Nps; and FIG. 49D: COBRA-X6+P1+ HK77 HA-Nps.

FIG. 50A shows HA antibody titers measured by Enzyme-Linked Immunosorbent Assay (ELISA) on plates coated with H1/New Caledonia/20/1999 HA trimers at the indicated timepoints with immunizations at weeks 0, 4 and 10. FIG. 50B shows neutralization IC50 of lentivirus pseudotyped with H1/New Caledonia/20/1999 HA and NA. FIG. 50C shows neutralization IC50 of lentivirus pseudotyped with H5/Vietnam/1203/2004 HA and NA. This data demonstrates the self-adjuvanting property of the H1/Stem-Np-TLR-agonist conjugates in a primate model.

SM7/8a and single-chain gL/gH ferritin nanoparticles conjugated to SM7/8a compared to treatment with single-chain gL/gH ferritin nanoparticles conjugated to SM7/8a and naked ferritin, as measured by ELISA. Results are shown for experiments without (FIG. 65A) or with (FIG. 65B) admixed AF03.

FIGS. 66A-66B show anti-gp220 antibody responses in mice after treatment with gp220 nanoparticles conjugated to SM7/8a and single-chain gL/gH nanoparticles conjugated to SM7/8a compared to treatment with gp220 nanoparticles conjugated to SM7/8a and naked ferritin, as measured by ELISA. Results are shown for experiments without (FIG. 66A) or with (FIG. 66B) admixed AF03.

FIG. 67 shows anti-gL/gH antibody responses in mice after treatment with single-chain gL/gH nanoparticles (gL/gH_C5; SEQ ID NO: 419) and naked ferritin, with or without either or both of admixed AF03 adjuvant and/or SM7/8a conjugated to the single-chain gL/gH nanoparticles, as measured by ELISA endpoint titer.

FIG. 68 shows anti-gp220 antibody responses in mice after treatment with gp220 nanoparticles and naked ferritin, with or without either or both of admixed AF03 adjuvant and/or SM7/8a conjugated to the gp220 nanoparticles.

FIG. 69 shows anti-gL/gH antibody responses in mice after treatment with bivalent compositions comprising gp220 nanoparticles and single-chain gL/gH nanoparticles. As indicated in the legend, some nanoparticles were conjugated to SM7/8a, and some nanoparticles were admixed with AF03. The order of symbols from top to bottom in the key matches the order of symbols from left to right in the graph.

FIG. 70 shows anti-gp220 antibody responses in mice after treatment with bivalent compositions comprising single-chain gL/gH nanoparticles and gp220 nanoparticles and/or naked ferritin. As indicated in the legend, some nanoparticles were conjugated to SM7/8a, and some nanoparticles were admixed with AF03. The order of symbols from top to bottom in the key matches the order of symbols from left to right in the graph.

FIGS. 71A-71D show antibody responses in mice after treatment with gL_gH_C7 nanoparticle (SEQ ID NO: 420) with or without admixed AF03 adjuvant and/or conjugation to SM7/8a (FIG. 71A, 71C, or 71D) or CpG oligodeoxynucleotide (FIG. 71B). Shown are endpoint titer from prime bleed measured by ELISA (FIG. 71A), ELISA results at individual dilutions from booster bleed (FIG. 71B), and endpoint titers measured by ELISA from booster bleed (FIG. 71C) and terminal bleed (FIG. 71D).

FIG. 72 shows antibody responses in mice after treatment with the gL_gH_C5 nanoparticle (SEQ ID NO: 419) with or without admixed AF03 adjuvant and/or conjugation to SM7/8a as endpoint titers measured by ELISA from the prime, boost, and terminal bleeds.

FIG. 73 shows antibody responses in mice after treatment with a gp220 nanoparticle with or without admixed AF03 adjuvant and/or conjugation to SM7/8a as endpoint titers measured by ELISA from the prime, boost, and terminal bleeds.

FIG. 74A shows the light and heavy chains of *T. ni* ferritin with or without fusion to either gp220 or gL/gH, visualized by Coomassie staining. The 20, 25, 75, 100, and 150 kDa markers in the rightmost lane of FIG. 74A are labeled. FIG. 74B provides an illustration of the constructs comprising light and heavy chains of *T. ni* ferritin with or without fusion to either gp220 or gL/gH.

FIGS. 75A-75D demonstrate ion exchange (Q column) chromatographic and size-exclusion chromatographic (SEC) purification of gp220-*T. ni* ferritin. Shown are absorbance traces from the Q column at pH 7 (FIG. 75A) and SEC Superose® 6, 16/600 (FIG. 75B); Coomassie staining of fractions from Q column at pH 7 (FIG. 75C) (lanes from left are input ("In"), flow-through ("FT"), mol. wt. ladder (sizes labeled at left in kD), and selected fractions); and Coomassie staining of fractions from SEC Superose® 6, 16/600 (FIG. 75D) (lanes from left are mol. wt. ladder (sizes labeled at left in kD) and selected fractions). FIG. 75E shows an illustration of the constructs.

FIGS. 76A-76D demonstrate ion exchange (Q column) chromatographic and size-exclusion chromatographic (SEC) purification of gL/gH (Light)/gp220 (Heavy)-*T. ni* ferritin. Shown are absorbance traces from the Q column at pH 7 (FIG. 76A) and SEC Superose® 6, 16/600 (FIG. 76B); Coomassie staining of fractions from Q column at pH 7 (FIG. 76C) (lanes from left are input ("In"), flow-through ("FT"), mol. wt. ladder (sizes labeled at left in kD), and selected fractions); and Coomassie staining of fractions from SEC Superose® 6, 16/600 (FIG. 76D) (lanes from left are mol. wt. ladder (sizes labeled at left in kD) and selected fractions). FIG. 76E shows an illustration of the constructs.

FIGS. 77A-77H show gp220-*T. ni* ferritin or gL/gH (light chain)/gp220 (heavy chain)-*T. ni* ferritin constructs visualized by Coomassie staining Coomassie (FIG. 77A and FIG. 77E), illustrated diagrammatically (FIG. 77B and FIG. 77F), characterized by dynamic light scattering (DLS) (FIG. 77D and FIG. 77H), and visualized in electron micrographs (FIG. 77C and FIG. 77G). FIGS. 77A-77D present data with gp220 fused to both the light and the heavy chain (diagram in FIG. 77B). FIGS. 77E-77H present data with gp220 fused to the heavy chain and gL/gH fused to the light chain (diagram in FIG. 77F).

FIGS. 78A-FIG. 78C show naked *T. ni* ferritin particles (i.e., not fused to a non-ferritin polypeptide) visualized by Coomassie staining (FIG. 78A), visualized in electron micrographs (FIG. 78B), and characterized by DLS (FIG. 78C).

FIG. 79A shows a SDS denaturing Coomassie-stained gel (at left) with a purified gH/gL/gp42 NP construct (SEQ ID NO: 227), which was expressed in 293 expi cells, and (at right) the size exclusion chromatography (SEC) peak of the gH/gL/gp42 NP. Units of the horizontal axis of the SEC chromatogram are mL. FIG. 79B shows the gH/gL/gp42 NP purified from the CHO pools to have a dynamic light scattering radius of around 26.2 nm.

FIG. 80A-B show an assessment of the immune response elicited by a monovalent gH/gL/gp42 nanoparticle composition in combination with a naked ferritin nanoparticle or a bivalent composition (gH/gL/gp42 nanoparticle in combination with a gp220). FIG. 80A shows B cell neutralization. FIG. 80B shows epithelial cell neutralization.

FIGS. 81A-E show endpoint binding titers against the indicated antigens.

FIGS. 81F-G show an EBV viral neutralizing assay (in B cells and epithelial cells, respectively) of sera from ferrets vaccinated as indicated. Prime=Inj. 1 and Boost=Inj. 2.

FIGS. 82A-B: FIG. 82A shows purification of gH/gL/gp42_NP_C12 (SEQ ID NO: 228) using Superose 6 size exclusion chromatography. The arrow depicts the fractions collected from the peak with a denaturing coomassie gel analysis and a western blot analysis using anti-ferritin antibodies. FIG. 82B is a dynamic light scattering analysis of the sample in FIG. 31A, which shows the particle size radius of 20.6 nm.

FIGS. 83A-B: FIG. 83A shows purification of gH/gL/gp42_NP_C13 (SEQ ID NO: 229) using the Superose 6 size exclusion chromatography. The arrow depicts the fractions collected from the peak with a denaturing coomassie gel analysis and a western blot analysis using anti-ferritin antibodies.

FIG. 84A shows purification of gH/gL/gp42_NP_C14 (SEQ ID NO: 230) using the Superose 6 size exclusion chromatography. The arrow depicts the fractions collected from the peak with a denaturing coomassie gel analysis and a western blot analysis using anti-ferritin antibodies. FIG. 84B is a dynamic light scattering analysis of the sample in FIG. 84A, which shows the particle size radius of 16.9 nm.

FIG. 85: An SDS reducing coomassie gel on the left shows the purified single-chain gH/gL/gp42-His product (SEQ ID NO: 226). The protein was purified using Nickel affinity chromatography. On the right is a 2.9 Angstrom crystal structure of the single-chain gH/gL/gp42-His product (SEQ ID NO: 226). Gp42 (in dark gray and indicated with arrows) interacts with the gH/gL heterodimer.

FIG. 86A-E: A cartoon of a single-chain construct of gH/gL/gp42 fused to ferritin (as in each of SEQ ID NOs: 227-231) is shown in FIG. 86A. The fusion between each protein is via a flexible amino acid linker or a rigid amino acid linker specified above. The single-chain gH/gL/gp42 molecule will assure a 1:1:1 ratio of heterotrimer formation on the nanoparticle. The crystal structure of this heterotrimer has been solved to show that the single-chain gH/gL/gp42 can adopt a heterotrimer formation similar to wild-type gH, gL, and gp42 proteins found in nature (FIG. 86B; see also FIG. 85). FIG. 86C is a model of how this single-chain gH/gL/gp42 heterotrimer is displayed on the nanoparticle through the fusion with ferritin. There are twenty-four copies of the single-chain gH/gL/gp42 displayed on a single nanoparticle. FIG. 86D shows the purification after expression of SEQ ID NOs: 227 in 293Expi cells. A denaturing SDS Coomassie gel shows the gH/gL/gp42 fused to ferritin to be above 150 kD with glycosylation. FIG. 35E shows negative stain electron microscopy analysis of the purified product, indicating that the single-chain gH/gL/gp42 fused to ferritin can successfully form nanoparticles displaying the gH/gL/gp42 antigens on the surface.

FIGS. 87A-87D show an exemplary RSV Pre-F-NP polypeptide structure. (FIG. 87A) Linear diagram listing residue numbers corresponding to the N terminus of each segment. Numbering is according to SEQ ID NO: 526. Domains 1-3 are indicated with DI, DII and DIII, respectively, and heptad repeat region A (HRA) and heptad repeat region B (HRB) are also labeled. The C-terminal ferritin is labeled (Ferritin Nanoparticle). The F1 and F2 fragments of the RSV F moiety are labeled below the cartoon. The region between the F1 and F2 fragment, where the peptide 27 fragment (p27) fusion peptide (FP) and furin cleavage sites (furin sites) were deleted and replaced with a flexible linker to form single chain F constructs, is depicted as a line and labeled above the cartoon. Stars above the diagram indicate approximate locations of engineered glycosylation sites E328N, S348N and R507N. (FIG. 87B) Structural model of pre-fusion RSV F moiety indicating key neutralizing (Nab) epitopes for D25, AM14, 101F, and Palivizumab antibodies. The approximate region of shared pre-fusion and post-fusion structural epitopes is indicated with a white triangle. The locations of exemplary engineered glycosylation sites E328N, S348N and R507N are labeled. The engineered glycosylation sites map to regions structurally shared between pre-fusion and post-fusion conformations and away from key neutralizing epitopes recognized by antibodies such as D25, AM14, 101F and Palivizumab. As such, constructs containing these engineered glycan sites still bind to the above neutralizing antibodies (data not shown). (FIG. 87C) Structural model of RSV pre-fusion F protein nanoparticle (Pre-F-NP) with HRA and HRB regions shaded darker. The resulting folded Pre-F-NP constructs can form 24-mers that display the key epitopes listed in FIG. 87B. (FIG. 87D) 2D class averages of electron micrographs of RSV Pre-F-NP construct RF8085 (SEQ ID NO: 501) showing symmetry of RSV F trimer moieties on the 24-mer ferritin nanoparticle.

FIG. 88 shows small-scale expression of several Pre-F-NP constructs expressed in 293 cell conditioned media as measured by D25 antibody Western blot. RF8090 is SEQ ID NO: 502, which is a cloning variant used in CHO expression having the same sequence as RF8085, i.e., SEQ ID NO: 501. RF8085 and RF8090 are Pre-F-NP constructs harboring the disulfide and cavity filling mutations of DS-CAV with the deletions and single chain linker described in FIG. 87A fused N-terminally to ferritin. RF8100-RF8105 and RF8108-RF8112 have the sequences of SEQ ID NOs: 503-508 and 511-514, respectively. scF-pFerr=fusion protein of RSV F polypeptide and ferritin. Mutations that appear to improve expression of the construct relative to the RF8090 benchmark are indicated below the Western blot. Notable mutations include the addition of glycan sites via the E328N, S348N and R507N mutations and the central helix capping mutation I327P, which increased expression and secretion of the RSV F nanoparticle into the conditioned media as measured by Western blot.

FIG. 89 shows expression of RF8085 (SEQ ID NO: 501; control construct) and RF8106 (SEQ ID NO: 509; comprising a I217P mutation as in RF8108 and lacking the disulfide (DS) mutation of DS-CAV1) as measured by the Western blot analysis of conditioned media from 293 expression. Replacing the DS with the central helix capping mutation I217P increased expression significantly. Replacing the DS with the central helix capping mutation does not affect binding of the construct to pre-fusion-specific antibodies D25 and AM14.

FIG. 90 shows results of size exclusion chromatography purification of the RF8106 construct (SEQ ID NO: 509). The retention volume of the RF8106 nanoparticle of approximately 65 ml on the Superose 6 preparatory SEC column is consistent with a folded 24-mer nanoparticle, suggesting the mutations in RF8106 did not hinder nanoparticle formation.

FIGS. 91A-91B show dynamic light scattering (DLS) analysis of nonreduced (79A) and reduced (79B) RF8106. Like the SEC analysis, the DLS demonstrates that the RSV Pre-F-NP formed the expected, folded nanoparticle. The reduced data further show that the particle was not disrupted by reduction, which was performed before adjuvant conjugation to the surface-exposed cysteine introduced on ferritin by a mutation (see FIG. 92).

FIG. 92 shows a coomassie-stained SDS-PAGE gel analysis of RF8106 with and without conjugation to the TLR9 agonist CpG. The increased gel shift of the CpG-treated nanoparticle demonstrated that the CpG adjuvant can be added to the RSV F nanoparticle to approximately 40-50% completion. Conjugation of CpG or other immune-stimulatory moieties such as TLR7/8 agonist SM7/8 did not inhibit the particle's ability to bind pre-fusion specific antibodies D25 and AM14.

FIG. 93 shows Western blot of nanoparticles comprising RSV F with (RF8117, SEQ ID NO: 517) and without additional glycans (RF8085, SEQ ID NO: 501; and RF8113, SEQ ID NO: 516). RF8113 is like RF8106, but the S111C surface-exposed cysteine (using ferritin residue numbering, i.e., corresponding to positions in the ferritin sequence of SEQ ID NO: 208) from RF8106 has been replaced with a K79C surface-exposed cysteine (also using ferritin residue numbering) to place the conjugation site further from the Pre-F moiety. Like RF8106, RF8113 retains improved expression over the benchmark molecule RF8085. RF8117 is like RF8113 but further comprises the three glycosylation mutations identified in FIG. 88, i.e. E328N, S348N and R507N, to further improve expression and block the non-neutralizing epitopes shared between the Pre-fusion F and Post-fusion F conformations as described in FIG. 87B.

(FIG. 95A) Expression of RF8117 and RF8140 from three and four pools of CHO cells, respectively, into CHO conditioned media was compared to yields of RF8090 in CHO conditioned media by D25-Western blot analysis. All three CHO pools for RF8117 and all four CHO pools for RF8140 express to higher yields than RF8090. (FIG. 95B) Expression of RF8117 into CHO conditioned media as measured by D25 pre-fusion F-specific antibody by Octet. The left panel shows response of RF8140 purified from 293 media of known concentrations plotted against response of binding to D25 on a Protein A tip providing a standard curve. Individual dots represent responses to D25 binding from RF8117 CHO conditioned media. The right panel shows calculated yield of RF8117 or RF8140 in CHO pool conditioned media based on D25 binding response. Both RF8117 and RF8140 were expressed in the media as measured by D25 and AM14 binding, demonstrating that like 293 cells, CHO cells are able to express the Pre-F-NPs in a folded manner which retains the pre-fusion F trimer structure.

(FIG. 96A) Comparison of RSV neutralizing titers elicited by High Dose (1 µg) and Low Dose (0.1 µg) immunization of DS-CAV1 (Pre-F Trimer, SEQ ID NO: 525), Post-fusion F Trimer (Post-F Trimer; SEQ ID NO: 524) or Pre-F-NP with engineered glycosylation (Pre-F-NP; RF8117, SEQ ID NO: 517) was measured by VERO cell assay. All RSV polypeptides were administered with adjuvant AF03 as described herein. Throughout, unless states otherwise, AF03 was administered with the RSV polypeptide or nanoparticle, but not conjugated to it. RSV polypeptides and doses are labeled below the x-axis. Statistical analysis of high dose responses relative to Pre-F-NP immunization is indicated. (FIG. 96B) Comparison of RSV neutralizing titers elicited by High Dose (1 µg) and Low Dose (0.1 µg) immunization with DS-CAV1 (Pre-F Trimer), Pre-F-NP without engineered glycosylation (RF8113, SEQ ID NO: 516) or Pre-F-NP with engineered glycosylation (RF8117, SEQ ID NO: 517) as measured by VERO cell assay. All RSV polypeptides were administered with adjuvant AF03 (not conjugated to any polypeptide or nanoparticle) as described herein. RSV polypeptides and doses are labeled below the x-axis.

(FIG. 97A) Pre-fusion F trimer binding antibody responses elicited in mice from immunization between post-fusion F and Pre-F-NP (RF8140, SEQ ID NO: 523) are compared. (FIG. 97B) Neutralizing antibody responses elicited in mice from immunization with post-fusion F and Pre-F-NP (RF8140, SEQ ID NO: 523) are shown. (FIG. 97C) Pre-fusion F trimer binding antibody responses elicited in non-human primates by Pre-F-NP with or without adjuvant (AF03, indicated in parentheses below) are compared. (FIG. 97D) RSV neutralizing titers elicited by immunization with Pre-F-NP (RF8140, SEQ ID NO: 523) with and without AF03 adjuvant are compared. In mice, Pre-F-NP elicits a higher pre-fusion F binding response and RSV neutralizing response compared to post-fusion trimer. In non-human primates, Pre-F-NP elicits a potent neutralizing response.

FIGS. 98A-98B show that engineered glycosylation sites block post-fusion epitopes. (FIG. 98A) Antibody response to pre-fusion F (DS-CAV1) elicited by immunization with Pre-F-NP without engineered glycosylation (RF8113) or Pre-F-NP with engineered glycosylation (Engineered Gly Particle) at high (1 µg) and low (0.1 µg) dose as measured by Octet is shown. (FIG. 98B) Antibody response to post-fusion trimer elicited by immunization with Pre-F-NP without engineered glycosylation (RF8113) or Pre-F-NP with engineered glycosylation (RF8117) at high (1 µg) and low (0.1 µg) dose as measured by Octet is shown. As above, all RSV polypeptides were mixed with AF03 during immunization. While both RF8113 and RF8117 elicit robust antibody responses to pre-fusion F, the post-fusion F antibody response elicited by RF8117 is greatly reduced. This is due to the engineered glycans mapping to the shared pre-fusion and post-fusion epitopes (FIG. 88B).

(FIG. 99A) Comparison of RSV neutralizing titers elicited by immunization with Pre-F NP with wild-type glycosylation sites ("Wt Glycan Particle"; RF8113, SEQ ID NO: 516) versus Pre-F NP with additional engineered glycosylation sites ("+Glycan Particle"; RF8117, SEQ ID NO: 517) at 0.1 µg dose in mouse studies as measured by VERO cell assay. (FIG. 99B) Comparison of RSV Post-fusion F trimer-binding antibody responses elicited by immunization with Wt Glycan Particle (RF8113, SEQ ID NO: 516) versus +Glycan Particle (RF8117, SEQ ID NO: 517) at 0.1 µg dose in mouse studies. (FIG. 99C) Ratio of measured neutralization titers to binding titers from panels A and B demonstrating that the engineered glycans did not reduce the functional, neutralizing antibody response but did decrease the non-neutralizing antibodies elicited to the shared pre-fusion/post-fusion epitopes (FIG. 87B), thus improving the Neutralizing/Binding antibody ratio.

(FIG. 100A) Coomassie-stained SDS-PAGE gel showing the click-conjugation of RSV G central domain (SEQ ID NO. 529) to ferritin nanoparticle, forming the Gcc-NP antigen. (FIG. 100B) Structural model of Gcc-NP. (FIG. 100C) Comparison of Gcc-binding antibody responses elicited by immunization with Gcc peptide alone (Gcc peptide, SEQ ID NO. 529) versus Gcc peptide conjugated to nanoparticle (Gcc-NP) in mouse studies. A representative response from naïve sera is shown in white box, while responses from post-second immunization are shown in light grey boxes and responses from post-third immunizations are shown in dark grey boxes. (FIG. 100D) Comparison of RSV neutralizing titers elicited by immunization with Gcc peptide (SEQ ID NO. 529) versus Gcc-NP in mouse studies post-third injection as measured by HAE cell assay. Sera from naïve animals and sera from animals immunized with Gcc peptide were pooled and titers are shown as bars.

(FIG. 101A) Immunization of mice with RF8140 alone (Pre-F-NP) or RF8140 and Gcc-NP (Pre-F-NP+Gcc-NP) elicited antibodies that bind pre-fusion F trimer. (FIG. 101B) Immunization of mice with Gcc-NP alone (Gcc-NP) or RF8140 and Gcc-NP (Pre-F-NO+Gcc-NP) elicited antibodies that bind Gcc peptide. (FIG. 101C) Animals immunized with either Pre-F-NP alone, Gcc-NP alone, or the co-administration of Pre-F-NP and Gcc-NP elicit a neutralizing response post-second and post-third immunization as measured by HAE neutralizing assay. Co-administration of Pre-F-NP+Gcc-NP elicited a neutralizing response superior to that elicited by immunization with only Pre-F-NP.

(FIG. 102A) Neutralizing titers were observed in VERO cell assays for sera from RF8140 immunization and RF8140+Gcc-NP co-administration, but not naïve sera or sera from Gcc-NP immunization alone. Depletion of sera from RF8140 or RF8140+Gcc-NP groups with pre-fusion F trimer reduced the measurable neutralizing titers. (FIG. 102B) Neutralizing titers were observed in HAE cell assays for sera from animals immunized with RF8140, Gcc-NP, or RF8140 co-administered with Gcc-NP. Sera from naïve animals did not have a neutralizing response. Sera from animals immunized with RF8140 that is depleted with pre-fusion F trimer has a reduction in measurable neutralizing titer. Sera from animals immunized with Gcc-NP that is depleted with G ectodomain has a reduction in measurable neutralizing titer. Sera from animals immunized with a co-administration of RF8140 and Gcc-NP does not have a reduced measurable neutralizing titer when depleted with pre-fusion F trimer alone, but does have a reduced measurable neutralizing titer when depleted with both pre-fusion F trimer and G ectodomain. Together, these data suggest co-administration with the Pre-F-NP and Gcc-NP does not interfere with the antigens' respective abilities to elicit neutralizing antibodies to pre-fusion F or G.

(FIG. 103A) Neutralizing titers for sera from mice immunized with RF8117 either unadjuvanted (No Adj), adjuvanted with Alum, or adjuvanted with AF03 are shown as measured by VERO cell assay. (FIG. 103B) Neutralizing titers for sera from mice immunized with RF8117 either unadjuvanted (No Adj), RF8117 adjuvanted with SPA09, or RF8140 adjuvanted with AF03 are shown as measured by VERO cell assay. In all cases for either RF8117 or RF8140, in naïve mice adjuvanted groups elicited a higher neutralizing titer than non-adjuvanted groups.

(FIG. 104A) Pre-fusion F trimer-binding responses measured in NHP sera after immunization with RF8140 either unadjuvanted (No Adj), adjuvanted with AF03 or adjuvanted with SPA09 (two doses of SPA09 were used, as indicated below) as measured by ELISA. At all timepoints, adjuvanting with AF03 or SPA09 elicits a superior neutralizing response. (FIG. 104B) Neutralizing titers for sera from NHPs immunized with RF8140 either unadjuvanted (No Adj), adjuvanted with AF03 or adjuvanted with SPA09 (two doses of SPA09 were used, as indicated below) as measured by VERO cell assay. In all cases immunization with RF8140 with adjuvant elicits a higher neutralizing titer than non-adjuvanted groups at all timepoints.

FIGS. 105A-B. Conjugation of RF8140 to TLR7/8 agonist SM7/8 or TLR9 agonist CpG elicits a superior pre-fusion F-binding titer relative to unadjuvanted RF8140 alone. (FIG. 105A) Pre-fusion F trimer-binding response measured in sera from either naïve mice, mice immunized with unadjuvanted RF8140, mice immunized with RF8140 conjugated with SM7/8 adjuvant, RF8140 adjuvanted with 130 ng of SM7/8 or RF8140 adjuvanted with 20 µg SM7/8 are shown. RF8140 conjugated to SM7/8 elicits a higher pre-fusion F trimer-binding titer than unadjuvanted or SM7/8 adjuvanted groups. (FIG. 105B) Pre-fusion F trimer-binding response measured in sera from either naïve mice, mice immunized with unadjuvanted RF8140, mice immunized with RF8140 conjugated with CpG adjuvant, RF8140 adjuvanted with 680 ng of CpG or RF8140 adjuvanted with 20 µg SM7/8 are shown. RF8140 conjugated to SM7/8 elicits a higher pre-fusion F trimer-binding titer than unadjuvanted or SM7/8 adjuvanted groups.

FIGS. 106A-G. F-subunit vaccine candidates elicit pre-F directed neutralizing antibodies and a Th1 CD4$^+$ T cell response in the MIMIC system. (FIG. 106A) Anti-pre-F titers in MIMIC system were measured by AF after priming with each Ag at molar equivalent concentration of F with 10 ng/ml of pre-F NP (n=48-49 donors per group). (FIG. 106B) Microneutralization titers were measured and are represented in International units/ml (IU/ml). (FIG. 106C) A ratio between anti-pre-F and post-F>1 represents a higher level of pre-F-binding antibody versus post-F-binding antibody while a ratio value <1 represents a greater Ab response to post-F. (FIG. 106D) The production of TNFα in activated CD154+/CD4+ T cells re-stimulated with F protein loaded target cells was measured using flow cytometry, n=48. Statistical significance was determined via Tukey-Kramer-HSD multiple comparison (FIG. 106E) Pre-existing antibody titer in humans subjects (serostatus) is strongly correlated with the magnitude of the RSV immune response in MIMIC system. Linear regression plot showing anti-pre-F IgG in sera from each donor versus total anti-pre-F IgG response was generated by software or algorithm and the p value for the common slope was analyzed by statistics method (n=50). Y-axis represents anti-pre-F IgG levels obtained following priming with RSV. (FIG. 106F) As in FIG. 106E, linear regression plot showing anti-pre-F IgG in sera from each donor versus total anti-pre-F IgG after priming with F subunit vaccine candidates (post-F in squares, pre-F-NP in circles and DC-Cav1 in diamonds). The anti-pre-F IgG pre-existing circulating titers ranged from 199,800 to 3,037,600,000. Each dot represents the IgG value of each individual donor. (FIG. 106G) Comparison of Gcc-binding antibody responses elicited by treatment with Gcc peptide alone (Gcc peptide) versus Gcc peptide conjugated to nanoparticle (Gcc-NP) in human B-cells. A no treatment group is shown for comparison as above.

(FIG. 108A) Gcc-binding antibody responses elicited to the Gcc A2 strain measured at two weeks post the second injection (light grey boxes) and two weeks post the third injection (dark grey boxes) elicited by the high dose (5 µg) of RSV Gcc-NP. Naïve mouse sera response is shown as a negative control. (FIG. 108B) Gcc-binding antibody responses elicited to the Gcc A2 strain measured at two weeks post the second injection (light grey boxes) and two weeks post the third injection (dark grey boxes) elicited by the low dose (0.5 µg) of RSV Gcc-NP.

(FIG. 109A) Gcc-binding antibody responses elicited to the Gcc B1 strain measured at two weeks post the second injection (light grey boxes) and two weeks post the third injection (dark grey boxes) elicited by a high dose (5 µg) of RSV Gcc-NP. Naïve mouse sera response is shown as a negative control. (FIG. 109B) Gcc-binding antibody responses elicited to the Gcc B1 strain measured at two weeks post the second injection (light grey boxes) and two weeks post the third injection (dark grey boxes) elicited by a low dose (0.5 µg) of RSV Gcc-NP.

DETAILED DESCRIPTION

Figure 1D:
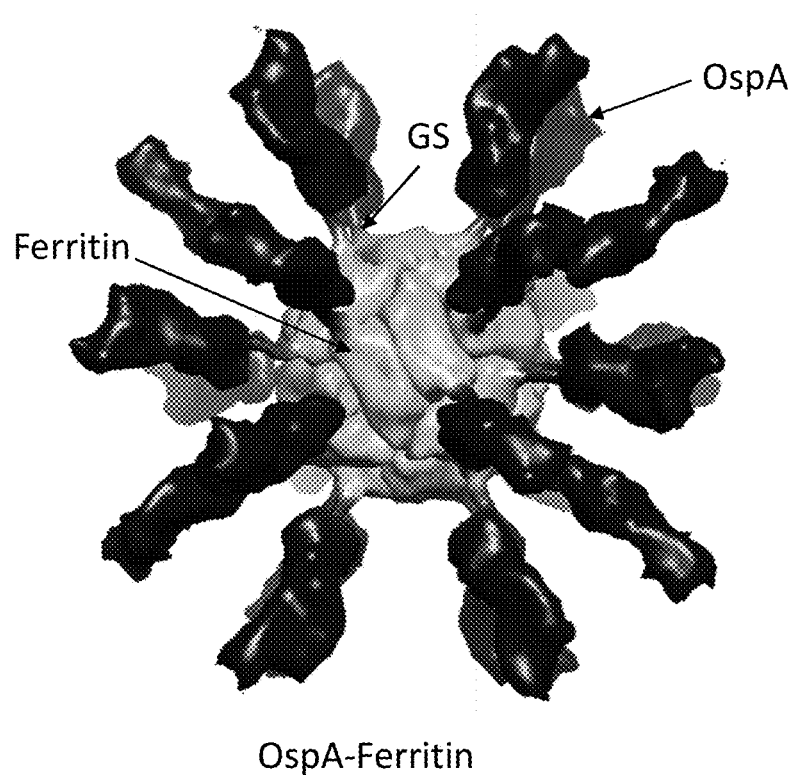

Provided herein are novel ferritin platform polypeptides and nanoparticles for use in immunization. The ferritin may comprise a mutation at a surface-exposed amino acid to change a non-cysteine amino acid to cysteine so that immune-stimulatory moieties may be directly conjugated to the engineered surface-exposed cysteine. The ferritin polypeptides provided herein can further comprise a non-ferritin polypeptide component, and can be antigenic when administered alone, with adjuvant as a separate molecule, and/or as part of a nanoparticle, which can be self-adjuvanting. The design of the ferritin platform proteins and nanoparticles may increase immunogenicity and/or eliminate or reduce the need for separately administered adjuvant, and also to potentially reduce the amount of adjuvant/immune-stimulatory moiety needed to elicit an immune response to a non-ferritin polypeptide associated with (e.g., fused to) the ferritin. Nucleic acids that encode the polypeptides described herein are also provided.

I. Definitions

"Ferritin" or "ferritin protein," as used herein, refers to a protein with detectable sequence identity to *H. pylori* ferritin (SEQ ID NO: 208 or 209) or another ferritin discussed herein, such as *P. furiosus* ferritin, *Trichoplusia ni* ferritin, or human ferritin, that serves to store iron, e.g., intracellularly or in tissues or to carry iron in the bloodstream. Such exemplary ferritins, including those that occur as two polypeptide chains, known as the heavy and light chains (e.g., *T. ni* and human ferritin), are discussed in detail below. In some embodiments, a ferritin comprises a sequence with at least 15%, 20%, 30%, 40%, 50%, 60%, 70%, 75%, 80%, 85%, 90%, 95%, 97%, 98%, 99%, or 99.5% identity to a ferritin sequence disclosed herein, e.g., in Table 1 (Sequence Table). A ferritin may be a fragment of a full-length naturally-occurring sequence. "Wild-type ferritin," as used herein, refers to a ferritin whose sequence consists of a naturally-occurring sequence. Ferritins also include full-length ferritin or a fragment of ferritin with one or more differences in its amino acid sequence from a wild-type ferritin.

As used herein, a "ferritin monomer" refers to a single ferritin molecule (or, where applicable, a single ferritin heavy or light chain) that has not assembled with other ferritin molecules. A "ferritin multimer" comprises multiple associated ferritin monomers. A "ferritin protein" includes monomeric ferritin and multimeric ferritin.

As used herein, "ferritin particle," refers to ferritin that has self-assembled into a globular form. Ferritin particles are sometimes referred to as "ferritin nanoparticles" or simply "nanoparticles". In some embodiments, a ferritin particle comprises 24 ferritin monomers (or, where applicable, 24 total heavy and light chains).

"Hybrid ferritin," as used herein, refers to ferritin comprising *H. pylori* ferritin with an amino terminal extension of bullfrog ferritin. An exemplary sequence used as an amino terminal extension of bullfrog ferritin appears as SEQ ID NO: 217. In hybrid ferritin, the amino terminal extension of bullfrog ferritin can be fused to *H. pylori* ferritin such that immune-stimulatory moiety attachment sites are distributed evenly on the ferritin particle surface. "Bullfrog linker" as used herein is a linker comprising the sequence of SEQ ID NO: 217. Hybrid ferritin is also sometimes referred to as "bfpFerr" or "bfp ferritin." Any of the constructs comprising a bullfrog sequence can be provided without the bullfrog sequence, such as, for example, without a linker or with an alternative linker. Exemplary bullfrog linker sequences are provided in Table 1. Where Table 1 shows a bullfrog linker, the same construct may be made without a linker or with an alternative linker.

"N-glycan," as used herein, refers to a saccharide chain attached to a protein at the amide nitrogen of an N (asparagine) residue of the protein. As such, an N-glycan is formed by the process of N-glycosylation. This glycan may be a polysaccharide.

"Glycosylation," as used herein, refers to the addition of a saccharide unit to a protein.

"Immune response," as used herein, refers to a response of a cell of the immune system, such as a B cell, T cell, dendritic cell, macrophage or polymorphonucleocyte, to a stimulus such as an antigen or vaccine. An immune response can include any cell of the body involved in a host defense response, including for example, an epithelial cell that secretes an interferon or a cytokine. An immune response includes, but is not limited to, an innate and/or adaptive immune response. As used herein, a "protective immune response" refers to an immune response that protects a subject from infection (e.g., prevents infection or prevents the development of disease associated with infection). Methods of measuring immune responses are well known in the art and include, for example, by measuring proliferation and/or activity of lymphocytes (such as B or T cells), secretion of cytokines or chemokines, inflammation, antibody production and the like. An "antibody response" is an immune response in which antibodies are produced.

As used herein, an "antigen" refers to an agent that elicits an immune response, and/or an agent that is bound by a T cell receptor (e.g., when presented by an MHC molecule) or to an antibody (e.g., produced by a B cell) when exposed or administered to an organism. In some embodiments, an antigen elicits a humoral response (e.g., including production of antigen-specific antibodies) in an organism. Alternatively, or additionally, in some embodiments, an antigen elicits a cellular response (e.g., involving T-cells whose receptors specifically interact with the antigen) in an organism. A particular antigen may elicit an immune response in one or several members of a target organism (e.g., mice, rabbits, primates, humans), but not in all members of the target organism species. In some embodiments, an antigen elicits an immune response in at least about 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99% of the members of a target organism species. In some embodiments, an antigen binds to an antibody and/or T cell receptor, and may or may not induce a particular physiological response in an organism. In some embodiments, for example, an antigen may bind to an antibody and/or to a T cell receptor in vitro, whether or not such an interaction occurs in vivo. In some embodiments, an antigen reacts with the products of specific humoral or cellular immunity, including those induced by heterologous immunogens. Antigens include antigenic ferritin proteins comprising ferritin (e.g., comprising one or more mutations) and a non-ferritin polypeptide as described herein.

An "immune-stimulatory moiety," as used herein, refers to a moiety that is covalently attached to a ferritin or antigenic ferritin polypeptide and that can activate a component of the immune system (either alone or when attached to ferritin or antigenic ferritin polypeptide). Exemplary immune-stimulatory moieties include agonists of toll-like receptors (TLRs), e.g., TLR 4, 7, 8, or 9. In some embodiments, an immune-stimulatory moiety is an adjuvant.

"Adjuvant," as used herein, refers to a substance or vehicle that non-specifically enhances the immune response to an antigen. Adjuvants can include, without limitation, a suspension of minerals (e.g., alum, aluminum hydroxide, or phosphate) on which antigen is adsorbed; a water-in-oil or oil-in-water emulsion in which antigen solution is emulsified in mineral oil or in water (e.g., Freund's incomplete adjuvant). Sometimes killed mycobacteria is included (e.g., Freund's complete adjuvant) to further enhance antigenicity. Immuno-stimulatory oligonucleotides (e.g., a CpG motif) can also be used as adjuvants (for example, see U.S. Pat. Nos. 6,194,388; 6,207,646; 6,214,806; 6,218,371; 6,239,116; 6,339,068; 6,406,705; and 6,429,199). Adjuvants can also include biological molecules, such as Toll-Like Receptor (TLR) agonists and costimulatory molecules. An adjuvant may be administered as a separate molecule in a composition or covalently bound (conjugated) to ferritin or an antigenic ferritin polypeptide.

"Antigenic ferritin polypeptide" and "antigenic ferritin protein" are used interchangeably herein to refer to a polypeptide comprising a ferritin and a non-ferritin polypeptide of sufficient length that the molecule is antigenic with respect to the non-ferritin polypeptide. The antigenic ferritin polypeptide may further comprise an immune-stimulatory moiety. Antigenicity may be a feature of the non-ferritin sequence as part of the larger construct. That is, it is sufficient that the construct can serve as an antigen against the non-ferritin polypeptide, regardless of whether the non-ferritin polypeptide without the ferritin (and immune-stimulatory moiety if applicable) could do so. The non-ferritin polypeptide can be a molecule obtained from, derived from, or similar to a polypeptide of a pathogenic agent, e.g., whole molecules or fragments of molecules from pathogens, which can produce a protective immune response against the pathogen in their host in the context of the antigenic ferritin polypeptide. The non-ferritin polypeptide may comprise a naturally-occurring sequence, or may be artificially designed or modified such that its structure is non-identical to the naturally-occurring molecule. For example, a polypeptide may differ from its naturally-occurring form such that it has greater immunogenicity or decreased risk of mediating an inappropriate response in the subject (e.g., an autoimmune response). In some embodiments, the non-ferritin polypeptide is an RSV, influenza, EBV, or OspA polypeptide, in which case the antigenic ferritin polypeptide is also an "antigenic X polypeptide" where X is RSV, influenza, EBV, or OspA. To be clear, however, an antigenic RSV, influenza, EBV, or OspA polypeptide does not need to comprise ferritin. "Antigenic polypeptide" is used herein to refer to a polypeptide which is either or both of an antigenic ferritin polypeptide and an antigenic RSV, EBV, or OspA polypeptide.

An "antigenic EBV polypeptide" is used herein to refer to a polypeptide comprising all or part of an EBV amino acid sequence of sufficient length that the molecule is antigenic with respect to EBV. Antigenicity may be a feature of the EBV sequence as part of a construct further comprising a heterologous sequence, such as a ferritin or lumazine synthase protein and/or immune-stimulatory moiety. That is, if an EBV sequence is part of a construct further comprising a heterologous sequence, then it is sufficient that the construct can serve as an antigen that generates anti-EBV antibodies, regardless of whether the EBV sequence without the heterologous sequence could do so.

An "antigenic RSV polypeptide" is used herein to refer to a polypeptide comprising all or part of an RSV amino acid sequence of sufficient length that the molecule is antigenic with respect to RSV. Antigenicity may be a feature of the RSV sequence as part of a construct further comprising a heterologous sequence, such as a ferritin and/or immune-stimulatory moiety. That is, if an RSV sequence is part of a construct further comprising a heterologous sequence, then it is sufficient that the construct can serve as an antigen that generates anti-RSV antibodies, regardless of whether the RSV sequence without the heterologous sequence could do so.

An "antigenic influenza-ferritin polypeptide" is used herein to refer to a molecule comprising a ferritin and an influenza polypeptide, wherein the molecule is antigenic with respect to the influenza polypeptide. Antigenicity may be a feature of the influenza polypeptide as part of the larger construct. That is, it is sufficient that the construct can serve as an antigen that generates antibodies against the influenza polypeptide, regardless of whether the influenza polypeptide without the ferritin could do so. In some embodiments, the influenza polypeptide and ferritin are genetically fused as a fusion protein. In some embodiments, the influenza polypeptide and ferritin are non-genetically linked, for example, by chemical conjugation.

An "antigenic OspA polypeptide" is used herein to refer to a polypeptide comprising all or part of an OspA of sufficient length that the polypeptide is antigenic with respect to OspA. Full-length OspA comprises a transmembrane domain and an ectodomain, defined below. Antigenicity may be a feature of the OspA sequence as part of a construct further comprising a heterologous sequence, such as a ferritin or lumazine synthase protein. That is, if an OspA is part of a construct further comprising a heterologous sequence, then it is sufficient that the construct can serve as an antigen that generates anti-OspA antibodies, regardless of whether the OspA sequence without the heterologous sequence could do so.

"Self-adjuvanting," as used herein, refers to a composition or polypeptide comprising a ferritin and an immune-stimulatory moiety directly conjugated to the ferritin so that the ferritin and immune-stimulatory moiety are in the same molecular entity. An antigenic ferritin polypeptide comprising a non-ferritin polypeptide may be conjugated to an immune-stimulatory moiety to generate a self-adjuvanting polypeptide.

A "surface-exposed" amino acid, as used herein, refers to an amino acid residue in a protein (e.g., a ferritin) with a side chain that can be contacted by solvent molecules when the protein is in its native three-dimensional conformation after multimerization, if applicable. Thus, for example, in the case of ferritin that forms a 24-mer, a surface-exposed amino acid residue is one whose side chain can be contacted by solvent when the ferritin is assembled as a 24-mer, e.g., as a ferritin multimer or ferritin particle.

As used herein, a "subject" refers to any member of the animal kingdom. In some embodiments, "subject" refers to humans. In some embodiments, "subject" refers to non-human animals. In some embodiments, subjects include, but are not limited to, mammals, birds, reptiles, amphibians, fish, insects, and/or worms. In certain embodiments, the non-human subject is a mammal (e.g., a rodent, a mouse, a rat, a rabbit, a monkey, a dog, a cat, a sheep, cattle, a primate, and/or a pig). In some embodiments, a subject may be a transgenic animal, genetically-engineered animal, and/or a clone. In certain embodiments of the present invention the subject is an adult, an adolescent or an infant. In some embodiments, terms "individual" or "patient" are used and are intended to be interchangeable with "subject".

As used herein, the term "vaccination" or "vaccinate" refers to the administration of a composition intended to generate an immune response, for example to a disease-causing agent. Vaccination can be administered before, during, and/or after exposure to a disease-causing agent, and/or to the development of one or more symptoms, and in some embodiments, before, during, and/or shortly after exposure to the agent. In some embodiments, vaccination includes multiple administrations, appropriately spaced in time, of a vaccinating composition.

As used herein, an "EBV polypeptide" refers to a polypeptide comprising all or part of an amino acid sequence encoded by EBV. Similarly, gL, gH, gp42, and gp220 polypeptides refer to polypeptides comprising all or part of a gL, gH, gp42, or gp220 amino acid sequence, respectively, encoded by EBV. Polypeptides with, e.g., at least 80% identity to an EBV-encoded polypeptide will necessarily comprise part of the EBV-encoded polypeptide. The terms "gL polypeptide," "gH polypeptide," "gp42 polypeptide," and "gp220 polypeptide" are used interchangeably with "EBV gL polypeptide," "EBV gH polypeptide," "EBV gp42 polypeptide," and "EBV gp220 polypeptide," respectively. Immunization with an EBV polypeptide as part or all of an antigenic polypeptide may confer protection from infection with EBV. Unless the context dictates otherwise, any polypeptide disclosed herein comprising an EBV polypeptide can comprise all or part of multiple sequences encoded by EBV (for example, all or part of gL and gH of EBV, or all or part of gL, gH, and gp42 of EBV).

As used herein, a "monomer," or "monomer construct," in the context of an EBV polypeptide, refers to a construct expressed as a single-chain protein. A monomer may comprise gL and gH of EBV expressed in a single chain, or gL, gH, and gp42 of EBV expressed in a single chain.

As used herein, a "trimer," or "trimer construct," in the context of an EBV polypeptide, refers to a construct comprising gL and/or gH of EBV together with a trimerization domain, such as a foldon trimerization domain derived from T4 phage fibritin. Other trimerization domains, such as the human collagen XVIII trimerization domain (see, e.g., Alvarez-Cienfuegos et al., Scientific Reports 2016; 6:28643) and the L1ORFlp trimerization domain (see, e.g., Khazina et al., Proc Natl Acad Sci USA 2009 Jan. 12; 106(3):731-36) are also known in the art and can be used in trimeric constructs.

"Antigenic site 0" or "site 0 epitope," as used herein, refer to a site located at the apex of the pre-fusion RSV F trimer, comprising amino acid residues 62-69 and 196-209 of wild-type RSV F (SEQ ID NO: 526). The site 0 epitope is a binding site for antibodies that have specificity for pre-fusion RSV F, such as D25 and AM14, and binding of antibodies to the site 0 epitope blocks cell-surface attachment of RSV (see McLellan et al., Science 340(6136):1113-1117 (2013)).

"Antigen stability," as used herein, refers to stability of the antigen over time or in solution.

"Cavity filling substitutions," as used herein, refers to engineered hydrophobic substitutions to fill cavities present in the pre-fusion RSV F trimer.

"F protein," or "RSV F protein" refers to the protein of RSV responsible for driving fusion of the viral envelope with host cell membrane during viral entry.

"RSV F polypeptide" or "F polypeptide" refers to a polypeptide comprising at least one epitope of F protein.

"Glycan addition," as used herein, refers to the addition of mutations which introduce glycosylation sites not present in a wild-type sequence (e.g., wild-type RSV F), which can be engineered to increase construct expression, increase construct stability, or block epitopes shared between the pre-fusion and post-fusion confirmation. A modified protein comprising glycan additions would have more glycosylation and therefore a higher molecular weight. Glycan addition of can reduce the extent to which an RSV F polypeptide elicits antibodies to the post-fusion conformation of RSV F.

"G protein" or "RSV G protein" as used herein, refers to the attachment protein responsible for associating RSV with human airway epithelial cells. An exemplary wild-type RSV G amino acid sequence is provided as SEQ ID NO: 527. RSV G protein comprises an ectodomain (approximately amino acids 66-297 of RSV G (SEQ ID NO: 527)) that resides extracellularly. Within the ectodomain of RSV G is a central conserved region (Gcc or CCR, approximately amino acids 151-193 of SEQ ID NO: 527). The CCR of RSV G comprises a CX3C motif. The CX3C motif mediates binding of G protein to the CX3CR1 receptor.

"Helix PRO capping" or "helix proline capping," as used herein, refer to when a helix cap comprises a proline, which can stabilize helix formation.

"Intra-protomer stabilizing substitutions," as used herein, describe amino acid substitutions in RSV F that stabilize the pre-fusion conformation by stabilizing the interaction within a protomer of the RSV F trimer.

"Inter-protomer stabilizing substitutions," as used herein, describe amino acid substitutions in RSV F that stabilize the pre-fusion conformation by stabilizing the interaction of the protomers of the RSV F trimer with each other.

"Protease cleavage" as used herein, refers to proteolysis (sometimes also referred to as "clipping" in the art) of susceptible residues (e.g., lysine or arginine) in a polypeptide sequence.

"Post-fusion," as used herein with respect to RSV F, refers to a stable conformation of RSV F that occurs after merging of the virus and cell membranes.

"Pre-fusion," as used herein with respect to RSV F, refers to a conformation of RSV F that is adopted before virus-cell interaction.

"Protomer," as used herein, refers to a structural unit of an oligomeric protein. In the case of RSV F, an individual unit of the RSV F trimer is a protomer.

"Hemagglutinin," or "HA," as used herein refers to the glycoprotein of any influenza virus responsible for binding to sialic acid on host cell membranes (an exemplary hemagglutinin is UniProt Accession No: P03451). HA encompasses synthetic polypeptides that are recognized by or can elicit anti-HA antibodies, such as COBRA P1, COBRA X6 and COBRA X3 described below.

"HA stem," as used herein, refers to an engineered influenza polypeptide designed from the conserved region of HA within the HA ectodomain, which lacks an intact HA head. By conserved, it is meant that the region maintains a significantly higher sequence identity between HA from different strains of influenza with different HA subtypes than the sequence identity of HA as a whole. HA stem antigens are discussed in detail, for example, in Impagliazzo et al., Science 2015 Sep. 18, 349(6254):1301-6; Valkenburg et al., Sci Rep. 2016 Mar. 7, 6:22666; Mallajosyula et al., Front Immunol. 2015, 6: 329.

"Neuraminidase," or "NA," as used herein refers to the glycoprotein of any influenza virus responsible for catalyzing the removal of terminal sialic acid residues from viral and cellular glycoconjugates (an exemplary Neuraminidase is UniProt Accession No: P03472).

Figure 26A:
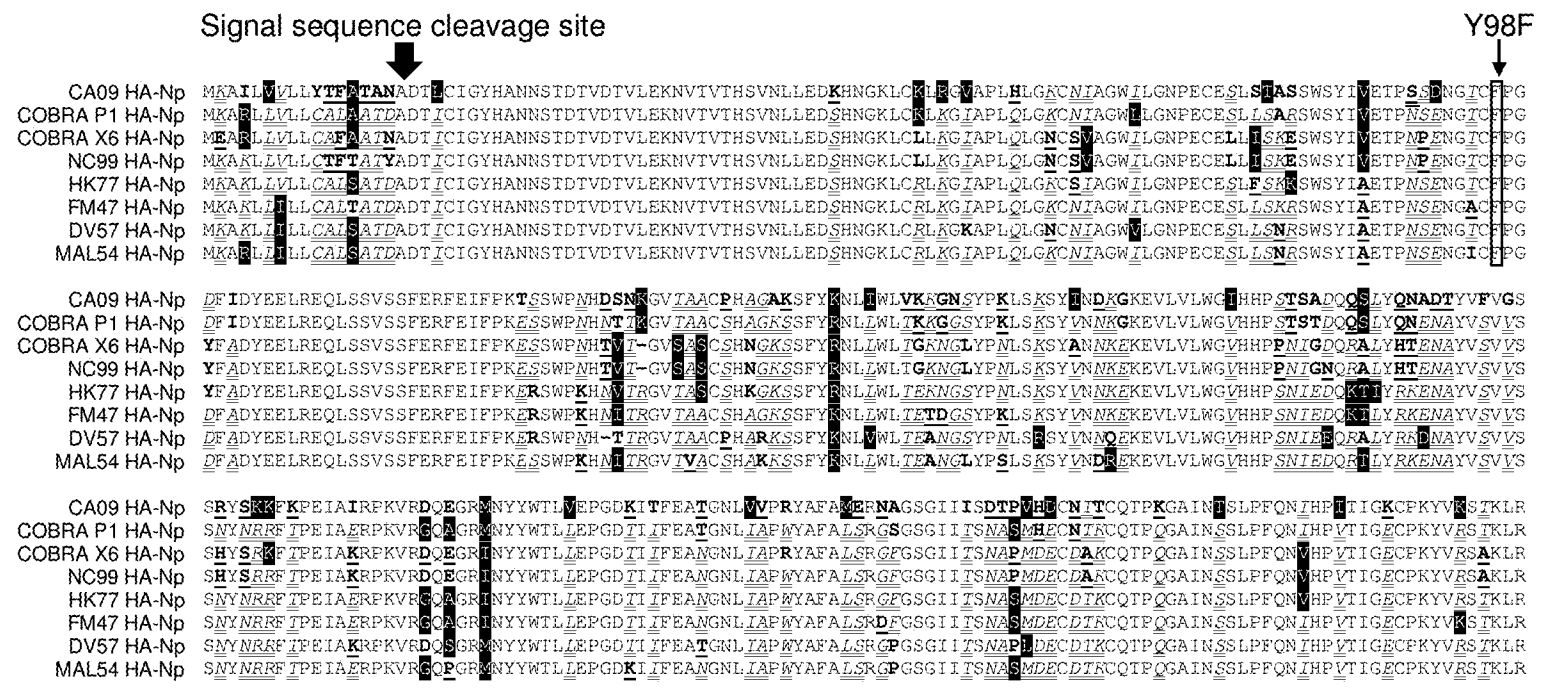
Figure 26B:
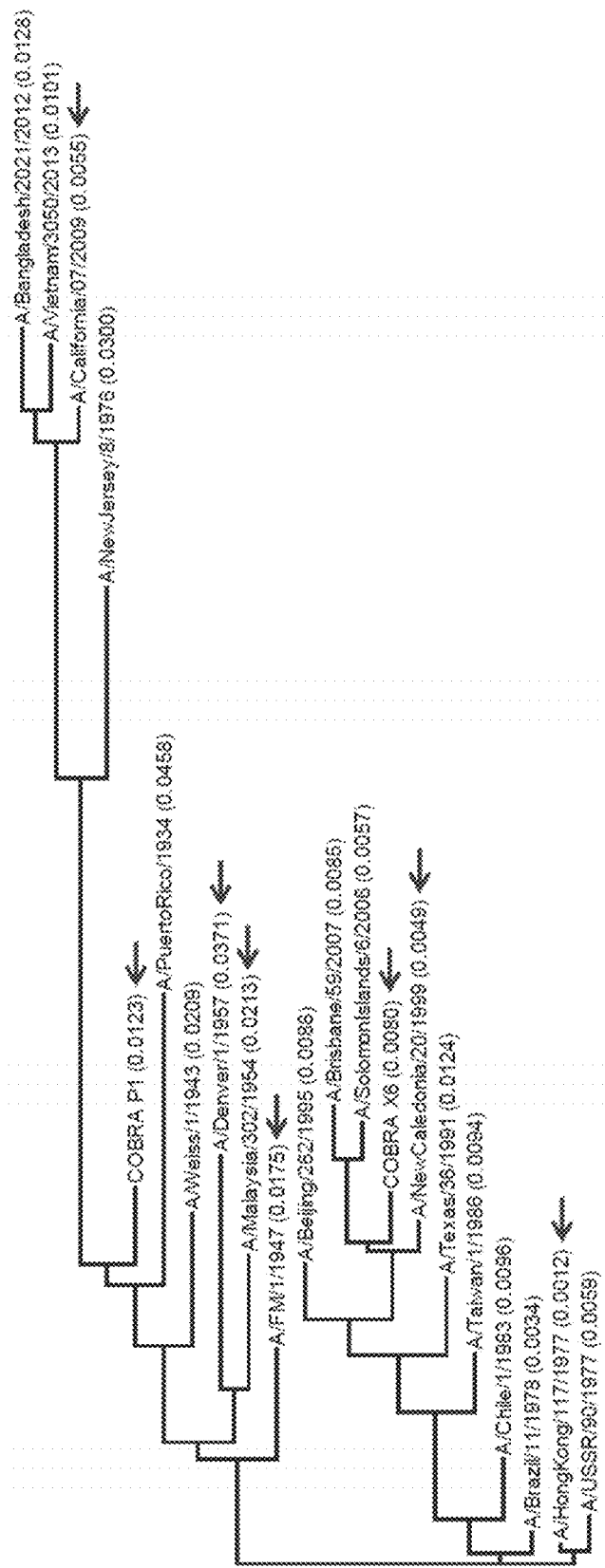

A "Y98F mutation," as used herein in the context of hemagglutinin, refers to the replacement of a tyrosine in a wild-type HA sequence that makes a direct contact to sialic acid with a phenylalanine. The location of the phenylalanine resulting from this mutation is shown in FIG. 26A. Although the exact location may differ in some HA subtypes, it can be identified by sequence alignment or structural analysis. The presence of a Y98F mutation in an HA sequence implies that the corresponding wild-type HA is a subtype comprising a tyrosine that makes a direct contact to sialic acid.

An "immune-stimulatory moiety," as used herein, refers to a moiety that is covalently attached to a ferritin or antigenic ferritin polypeptide and that can activate a component of the immune system (either alone or when attached to ferritin or antigenic ferritin polypeptide). Exemplary immune-stimulatory moieties include agonists of toll-like receptors (TLRs), e.g., TLR 4, 7, 8, or 9. In some embodiments, an immune-stimulatory moiety is an adjuvant.

As used herein, the term "kit" refers to a packaged set of related components, such as one or more compounds or compositions and one or more related materials such as solvents, solutions, buffers, instructions, or desiccants.

"N-glycan," as used herein, refers to a saccharide chain attached to a protein at the amide nitrogen of an N (asparagine) residue of the protein. As such, an N-glycan is formed by the process of N-glycosylation. This glycan may be a polysaccharide.

An "OspA ectodomain" as used herein refers to about amino acid residues 27-273 of *B. burgdorferi* OspA (UniProt Accession No. P0CL66) or the corresponding positions of a homolog thereof as identified by pairwise or structural alignment. Further examples of OspA ectodomains include positions 27-X of any of SEQ ID NOs: 83-89 where X is the C-terminal position of the relevant sequence, optionally wherein the C-terminal Lys is omitted. In some embodiments, an ectodomain further comprises at its N-terminus the 26th residue, or the 25th and 26th residues, of the corresponding full-length wild-type sequence; in SEQ ID NOs: 83-89, the 25th and 26th residues are Asp and Glu. Still further examples of OspA ectodomains include any of SEQ ID NOs: 94-102, optionally wherein the N-terminal 1, 2, or 3 residues (Met-Asp-Glu) are omitted, further optionally wherein the C-terminal Lys is omitted.

An "OspA transmembrane domain" as used herein refers to about amino acid residues 2-24 of *B. burgdorferi* OspA (UniProt Accession No. P0CL66) or the corresponding positions of a homolog thereof as identified by pairwise or structural alignment.

The disclosure describes nucleic acid sequences and amino acid sequences having a certain degree of identity to a given nucleic acid sequence or amino acid sequence, respectively (a references sequence).

"Sequence identity" between two nucleic acid sequences indicates the percentage of nucleotides that are identical between the sequences. "Sequence identity" between two amino acid sequences indicates the percentage of amino acids that are identical between the sequences.

The terms "% identical", "% identity" or similar terms are intended to refer, in particular, to the percentage of nucleotides or amino acids which are identical in an optimal alignment between the sequences to be compared. Said percentage is purely statistical, and the differences between the two sequences may be but are not necessarily randomly distributed over the entire length of the sequences to be compared. Comparisons of two sequences are usually carried out by comparing said sequences, after optimal alignment, with respect to a segment or "window of comparison", in order to identify local regions of corresponding sequences. The optimal alignment for a comparison may be carried out manually or with the aid of the local homology algorithm by Smith and Waterman, 1981, Ads App. Math. 2, 482, with the aid of the local homology algorithm by Needleman and Wunsch, 1970, J. Mol. Biol. 48, 443, with the aid of the similarity search algorithm by Pearson and Lipman, 1988, Proc. Natl Acad. Sci. USA 88, 2444, or with the aid of computer programs using said algorithms (GAP, BESTFIT, FASTA, BLAST P, BLAST N and TFASTA in Wisconsin Genetics Software Package, Genetics Computer Group, 575 Science Drive, Madison, Wis.).

Percentage identity is obtained by determining the number of identical positions at which the sequences to be compared correspond, dividing this number by the number of positions compared (e.g., the number of positions in the reference sequence) and multiplying this result by 100.

In some embodiments, the degree of identity is given for a region which is at least about 50%, at least about 60%, at least about 70%, at least about 80%, at least about 90% or about 100% of the entire length of the reference sequence. For example, if the reference nucleic acid sequence consists of 200 nucleotides, the degree of identity is given for at least about 100, at least about 120, at least about 140, at least about 160, at least about 180, or about 200 nucleotides, in some embodiments in continuous nucleotides. In some embodiments, the degree of identity is given for the entire length of the reference sequence.

Nucleic acid sequences or amino acid sequences having a particular degree of identity to a given nucleic acid sequence or amino acid sequence, respectively, may have at least one functional property of said given sequence, e.g., and in some instances, are functionally equivalent to said given sequence. One important property includes the ability to act as a cytokine, in particular when administered to a subject. In some embodiments, a nucleic acid sequence or amino acid sequence having a particular degree of identity to a given nucleic acid sequence or amino acid sequence is functionally equivalent to said given sequence.

As used herein, the term "kit" refers to a packaged set of related components, such as one or more compounds or compositions and one or more related materials such as solvents, solutions, buffers, instructions, or desiccants.

II. Exemplary Ferritins, Antigenic Ferritin Polypeptides, Conjugates, Compositions, Methods, and Uses Ferritin protein self-assembles into a globular protein complex comprising multiple individual monomers. The self-assembled ferritin complex may be referred to as a ferritin particle or nanoparticle.

Ferritin genes are found in many species and generally show a conserved highly alpha-helical structure despite sequence variation. As such, any ferritin can be used in the invention, including bacterial, insect, and human ferritin, despite its sequence identity to any particularly described ferritin.

In some embodiments, the ferritin is bacterial, insect, fungal, bird, or mammalian. In some embodiments, the ferritin is human. In some embodiments, the ferritin is bacterial. In some embodiments, the ferritin is *H. pylori* ferritin.

In some embodiments, the ferritin is a light chain and/or heavy chain ferritin. In some embodiments, the ferritin is human heavy chain ferritin (FTH1, GENE ID No: 2495) or human light chain ferritin (FTL, GENE ID No: 2512), optionally with one or more modifications described herein. In some embodiments, the ferritin is *Trichoplusia ni* heavy chain ferritin (GenBank: AY970291.1) or *Trichoplusia ni* light chain ferritin (AY970292.1), optionally with one or more mutations described herein. In some embodiments, a ferritin nanoparticle comprises 24 total subunits of heavy chain ferritin and light chain ferritin, e.g., 12 heavy chain subunits and 12 light chain subunits. In some embodiments, a ferritin comprises a mutation replacing a surface-exposed amino acid with a cysteine.

In some embodiments, an antigenic ferritin polypeptide is provided comprising ferritin and a non-ferritin polypeptide of sufficient length that the molecule is antigenic with respect to the non-ferritin polypeptide.

In some embodiments, the antigenic ferritin polypeptide comprises a heavy chain ferritin or a non-ferritin polypeptide and a light chain ferritin and a non-ferritin polypeptide. Such polypeptides can be combined to allow expression of two of the same or different non-ferritin polypeptides on a single ferritin multimer or particle. In some embodiments, the two different non-ferritin polypeptides are encoded by a single infectious agent. In some embodiments, the two different non-ferritin polypeptides are encoded by two different infectious agents. In some embodiments, the infectious agent is a virus or bacterium. In some embodiments, two different non-ferritin polypeptides are encoded by two different infectious agents, e.g., different pathogens such as influenza, *Borrelia*, RSV, or EBV, or different strains or types of a pathogen such as influenza, *Borrelia*, RSV, or EBV, and attached to heavy and light chain ferritins for assembly into a nanoparticle.

In some embodiments, the antigenic ferritin polypeptide comprises a heavy chain ferritin and a non-ferritin polypeptide assembled with a light chain ferritin and a non-ferritin polypeptide to produce a bivalent composition. In some embodiments, the ferritin is *H. pylori* ferritin (see SEQ ID NOS: 208 or 209 for exemplary *H. pylori* ferritin sequences) with one or more mutations described herein. In some embodiments, the lower sequence homology between *H. pylori* ferritin (or other bacterial ferritins) and human ferritin may decrease the potential for autoimmunity when used as a vaccine platform (see Kanekiyo et al., Cell 162, 1090-1100 (2015)).

In some embodiments, the ferritin is *Pyrococcus furiosus* ferritin (NCBI seq WP_011011871.1) with one or more mutations described herein.

In some embodiments, the ferritin comprises a sequence having greater than 70%, greater than 75%, greater than 80%, greater than 85%, greater than 90%, greater than 95%, greater than 97%, greater than 98%, or greater than 99% identity to a wild-type ferritin.

In some embodiments, a different protein capable of forming a nanoparticle is substituted for ferritin. In some embodiments, this protein is lumazine synthase (see Ra et al., Clin Exp Vaccine Res 3:227-234 (2014)). In some embodiments, this protein is lumazine synthase serotype 1, 2, 3, 4, 5, 6, or 7. Exemplary lumazine synthase sequences are provided as SEQ ID NO: 216 and 219. In some embodiments, the lumazine synthase comprises a sequence with 80%, 85%, 90%, 95%, 98%, or 99% identity to SEQ ID NO: 216 or 219.

A. Ferritin Mutations

Ferritins comprising one or more mutations are disclosed herein. In some embodiments, the one or more mutations comprise changes to the amino acid sequence of a wild-type ferritin and/or an insertion, e.g., at the N- or C-terminus. In some embodiments, one, two, three, four, five, or more different amino acids are mutated in the ferritin as compared to wild-type ferritin (in some embodiments, in addition to any N-terminal insertion). The one or more mutations can change functional properties of the ferritin, e.g., as discussed in detail below. In general, a mutation simply refers to a difference in the sequence (such as a substituted, added, or deleted amino acid residue or residues) relative to the corresponding wild-type ferritin.

1. Cysteine for Conjugation

In some embodiments, ferritin is mutated to provide a chemical handle for conjugation of an immune-stimulatory moiety and/or non-ferritin polypeptide. This can be achieved with a mutation replacing a surface-exposed non-cysteine amino acid with a cysteine. For the avoidance of doubt, language such as "replacing a surface-exposed amino acid with a cysteine" necessarily implies that the surface-exposed amino acid in the wild-type or pre-mutation sequence is not cysteine. Another approach for providing a chemical handle for conjugation of an immune-stimulatory moiety or non-ferritin polypeptide is to include a segment of amino acids, such as a linker, N- or C-terminal to the ferritin, wherein the segment of amino acids comprises a cysteine. In some embodiments, this cysteine (whether replacing a surface-exposed amino acid or in an N- or C-terminal linker) is unpaired, which means that it does not have an appropriate partner cysteine to form a disulfide bond. In some embodiments, this cysteine does not change the secondary structure of ferritin. In some embodiments, this cysteine does not change the tertiary structure of ferritin.

In some embodiments, this cysteine can be used to conjugate agents, such as immune-stimulatory moieties, to ferritin. In some embodiments, this cysteine provides a free thiol group that is reactive. In some embodiments, agents conjugated to this cysteine on ferritin are exposed on the surface of an assembled ferritin particle. In some embodiments, this cysteine can interact with molecules and cells of the subject after administration while the ferritin particle is assembled.

In some embodiments, the presence of this cysteine allows conjugation of one or more immune-stimulatory moieties, e.g., adjuvants. In some embodiments, conjugation of the immune-stimulatory moiety would not occur in the absence of this cysteine.

In some embodiments, the non-cysteine amino acid that is replaced with a cysteine is selected from E12, S72, A75, K79, S100, and S111 of H. pylori ferritin. Thus, in some embodiments, the surface-exposed amino acid that is replaced in favor of cysteine is an amino acid residue that corresponds to E12, S26, S72, A75, K79, S100, or S111 of H. pylori ferritin. Analogous amino acids can be found in non-H. pylori ferritin by pair-wise or structural alignment. In some embodiments, the non-cysteine amino acid that is replaced with a cysteine can be selected from an amino acid that corresponds to S3, S19, S33, I82, A86, A102, and A120 of human light chain ferritin. In some embodiments, the surface-exposed amino acid to be replaced with a cysteine is selected based on the understanding that if the native amino acid were replaced with cysteine, it would be reactive in an assembled ferritin multimer or particle and/or that this cysteine does not disrupt the stability of the ferritin multimer or particle and/or that this cysteine does not lead to reduction in expression levels of ferritin.

In some embodiments, the ferritin comprises an E12C mutation. In some embodiments, the E12C residue can be used to conjugate agents (e.g., immune-stimulatory moieties and/or non-ferritin polypeptides) to ferritin. In some embodiments, the E12C residue provides a free thiol group that is reactive. In some embodiments, agents conjugated to the E12C residue on ferritin monomers are expressed on the surface on an assembled ferritin multimer or particle. In some embodiments, twenty-four E12C residues (one from each monomer) are present on the surface of a ferritin multimer or particle.

In some embodiments, the ferritin comprises an S26C mutation. In some embodiments, the S26C residue can be used to conjugate agents (e.g., immune-stimulatory moieties and/or non-ferritin polypeptides) to ferritin. In some embodiments, the S26C residue provides a free thiol group that is reactive. In some embodiments, agents conjugated to the S26C residue on ferritin monomers are expressed on the surface on an assembled ferritin multimer or particle. In some embodiments, twenty-four S26C residues (one from each monomer) are present on the surface of a ferritin multimer or particle.

In some embodiments, the ferritin comprises an S72C mutation. In some embodiments, the S72C residue can be used to conjugate agents (e.g., immune-stimulatory moieties and/or non-ferritin polypeptides) to ferritin. In some embodiments, the S72C residue provides a free thiol group that is reactive. In some embodiments, agents conjugated to the S72C residue on ferritin monomers are expressed on the surface on an assembled ferritin multimer or particle. In some embodiments, twenty-four S72C residues (one from each monomer) are present on the surface of a ferritin multimer or particle.

In some embodiments, the ferritin comprises an A75C mutation. In some embodiments, the A75C residue can be used to conjugate agents (e.g., immune-stimulatory moieties and/or non-ferritin polypeptides) to ferritin. In some embodiments, the A75C residue provides a free thiol group that is reactive. In some embodiments, agents conjugated to the A75C residue on ferritin monomers are expressed on the surface on an assembled ferritin multimer or particle. In some embodiments, twenty-four A75C residues (one from each monomer) are present on the surface of a ferritin multimer or particle.

In some embodiments, the ferritin comprises an K79C mutation. In some embodiments, the K79C residue can be used to conjugate agents (e.g., immune-stimulatory moieties and/or non-ferritin polypeptides) to ferritin. In some embodiments, the K79C residue provides a free thiol group that is reactive. In some embodiments, agents conjugated to the K79C residue on ferritin monomers are expressed on the surface on an assembled ferritin multimer or particle. In some embodiments, twenty-four K79C residues (one from each monomer) are present on the surface of a ferritin multimer or particle.

In some embodiments, the ferritin comprises an S100C mutation. In some embodiments, the S100C residue can be used to conjugate agents (e.g., immune-stimulatory moieties and/or non-ferritin polypeptides) to ferritin. In some embodiments, the S100C residue provides a free thiol group that is reactive. In some embodiments, agents conjugated to the S100C residue on ferritin monomers are expressed on the surface on an assembled ferritin multimer or particle. In some embodiments, twenty-four S100C residues (one from each monomer) are present on the surface of a ferritin multimer or particle.

In some embodiments, the ferritin comprises an S111C mutation. In some embodiments, the S111C residue can be used to conjugate agents (e.g., immune-stimulatory moieties and/or non-ferritin polypeptides) to ferritin. In some embodiments, the S111C residue provides a free thiol group that is reactive. In some embodiments, agents conjugated to the S111C residue on ferritin monomers are expressed on the surface on an assembled ferritin multimer or particle. In some embodiments, twenty-four S111C residues (one from each monomer) are present on the surface of a ferritin multimer or particle.

2. Removal of Internal Cysteine

In some embodiments, the ferritin comprises a mutation replacing an internal cysteine with a non-cysteine amino acid. Removal of a native internal cysteine residue can ensure that there is only one unpaired cysteine per ferritin monomer and avoid undesired reactions such as disulfide formation and may result in a more stable and efficient result (e.g., adjuvant presentation). In some embodiments, C31 of *H. pylori* ferritin is replaced with a non-cysteine amino acid. In some embodiments, C31 of *H. pylori* ferritin is replaced with a serine (C31S), although any non-cysteine residue may be used, e.g., alanine, glycine, threonine, or asparagine. Analogous amino acids can be found in non-*H. pylori* ferritin by pair-wise or structural alignment. Thus, in some embodiments, the internal cysteine that is replaced in favor of non-cysteine is an amino acid residue that aligns with C31 of *H. pylori* ferritin. Exemplary ferritin sequences showing a C31S mutation are shown in SEQ ID NOS: 201-207. In some embodiments, when more than one internal cysteine is present in ferritin, two or more (e.g., each) internal cysteine is replaced with a non-cysteine amino acid, such as serine or an amino acid selected from serine, alanine, glycine, threonine, or asparagine.

3. Glycosylation

Human-compatible glycosylation can contribute to safety and efficacy in recombinant drug products. Regulatory approval may be contingent on demonstrating appropriate glycosylation as a critical quality attribute (see Zhang et al., Drug Discovery Today 21(5):740-765 (2016)). N-glycans can result from glycosylation of asparagine side chains and can differ in structure between humans and other organisms such as bacteria and yeast. Thus, it may be desirable to reduce or eliminate non-human glycosylation and/or N-glycan formation in ferritin according to the disclosure. In some embodiments, controlling glycosylation of ferritin improves the efficacy and/or safety of the composition, especially when used for human vaccination.

In some embodiments, ferritin is mutated to inhibit formation of an N-glycan. In some embodiments, a mutated ferritin has reduced glycosylation as compared to its corresponding wild type ferritin.

In some embodiments, the ferritin comprises a mutation replacing a surface-exposed asparagine with a non-asparagine amino acid. In some embodiments, the surface-exposed asparagine is N19 of *H. pylori* ferritin or a position that corresponds to position 31 of *H. pylori* ferritin as determined by pair-wise or structural alignment In some embodiments, mutating such an asparagine, e.g., N19 of *H. pylori* ferritin, decreases glycosylation of ferritin. In some embodiments, the mutation replaces the asparagine with a glutamine. In some embodiments, the ferritin is an *H. pylori* ferritin comprising an N19Q mutation. SEQ ID NOS: 201-207 are exemplary ferritin sequences comprising N19Q mutations.

A mammal exposed to a glycosylated protein produced in bacteria or yeast may generate an immune response to the glycosylated protein, because the pattern of glycosylation of a given protein in bacterial or yeast could be different from the pattern of glycosylation of the same protein in a mammal. Thus, some glycosylated therapeutic proteins may not be appropriate for production in bacteria or yeast.

In some embodiments, decreased glycosylation of ferritin by amino acid mutation facilitates protein production in bacteria or yeast. In some embodiments, decreased glycosylation of ferritin reduces the potential for adverse effects in mammals upon administration of mutated ferritin that is expressed in bacteria or yeast. In some embodiments, the reactogenicity in a human subject of a mutated ferritin produced in bacteria or yeast is lower because glycosylation is decreased. In some embodiments, the incidence of hypersensitivity responses in human subjects is lower following treatment with a mutated ferritin with reduced glycosylation compared to wild-type ferritin.

In some embodiments, degradation in a subject of a composition comprising a mutated ferritin with reduced glycosylation is slower compared with a composition comprising a wild-type ferritin, or a composition comprising a corresponding ferritin with wild-type glycosylation. In some embodiments, a composition comprising a mutated ferritin with reduced glycosylation has reduced clearance in a subject compared with a composition comprising a wild-type ferritin, or a composition comprising a corresponding ferritin with wild-type glycosylation. In some embodiments, a composition comprising a mutated ferritin with reduced glycosylation has a longer-serum half-life compared to wild-type ferritin, or a composition comprising a corresponding ferritin with wild-type glycosylation.

4. Combinations of Mutations

In some embodiments, a ferritin comprises more than one type of mutation described herein. In some embodiments, the ferritin comprises one or more mutations independently selected from: a mutation to decrease glycosylation, a mutation to remove an internal cysteine, and a mutation to generate a surface-exposed cysteine. In some embodiments, the ferritin comprises a mutation to decrease glycosylation, a mutation to remove an internal cysteine, and a mutation to generate a surface-exposed cysteine.

In some embodiments, the ferritin comprises an N19Q mutation, a C31S mutation, and a mutation to generate a surface-exposed cysteine. In some embodiments, the ferritin comprises an N19Q mutation, a C31S mutation, and an E12C mutation. In some embodiments, the ferritin comprises an N19Q mutation, a C31S mutation, and an S72C mutation. In some embodiments, the ferritin comprises an N19Q mutation, a C31S mutation, and an A75C mutation. In some embodiments, the ferritin comprises an N19Q mutation, a C31S mutation, and an K79C mutation. In some embodiments, the ferritin comprises an N19Q mutation, a C31S mutation, and an S100C mutation. In some embodiments, the ferritin comprises an N19Q mutation, a C31S mutation, and an S111C mutation. In some embodiments, the ferritin comprises mutations corresponding to any of the foregoing sets of mutations, wherein the corresponding mutations change an N to a Q, a C to an S, and a non-cysteine surface-exposed amino acid to a cysteine at positions determined by pair-wise alignment of the ferritin amino acid sequence to an *H. pylori* ferritin amino acid sequence (SEQ ID NO: 208 OR 209).

Exemplary ferritins comprising more than one type of mutation are provided in SEQ ID NOS: 201-207.

5. Structural Alignment

As discussed above, positions of mutations corresponding to those described with respect to *H. pylori* ferritin can be identified by pairwise or structural alignment. Structural alignment is relevant to large protein families such as ferritin where the proteins share similar structures despite considerable sequence variation and many members of the family have been structurally characterized, and can also be used to identify corresponding positions in different versions of other polypeptides described herein, such as influenza (e.g., hemagglutinin), *Borrelia* (e.g., OspA), RSV (e.g., RSV F or G), and EBV (e.g., gL, gH, gp220, or gp42). The protein databank (PDB) comprises 3D structures for many ferritins, including those listed below with their accession numbers.

2jd6, 2jd7—PfFR—*Pyrococcus furiosus*. 2jd8—PfFR+ Zn. 3a68—soFR from gene SferH4—soybean. 3a9q—soFR from gene SferH4 (mutant). 3egm, 3bvf, 3bvi, 3bvk, 3bv1—HpFR—*Heliobacter pylori*. 5c6f—HpFR (mutant)+Fe. 1z4a, 1vlg—FR—*Thermotoga maritime*. 1s3q, 1sq3, 3kx9—FR—*Archaeoglubus fulgidus*. 1krq—FR—*Campylobacter jejuni*. 1eum—EcFR—*Escherichia coli*. 4reu—EcFR+Fe. 4xgs—EcFR (mutant)+Fe2O2. 4ztt—EcFR (mutant)+Fe2O+Fe2+Fe+O2. 1qgh—LiFR—*Listeria innocua*. 3qz3—VcFR—*Vibrio cholerae*. 3vnx—FR—*Ulva pertusa*. 4ism, 4isp, 4itt, 4itw, 4iwj, 4iwk, 4ixk, 3e6s—PnmFR—Pseudo-nitschia multiseries. 4zkh, 4zkw, 4zkx, 4z15, 4z16, 4z1w, 4zmc—PnmFR (mutant)+Fe. 1z6o—FR—*Trichoplusia ni*. 4cmy—FR+Fe—*Chlorobaculum tepidum*. Ferritin light chain (FTL). 1lb3, 1 h96—mFTL—mouse. 1rcc, 1rcd, 1rci—bFTL+tartrate+Mg. 1rce, 1rcg—bFTL+tartrate+Mn. 3noz, 3np0, 3np2, 3o7r—hoFTL (mutant)—horse. 3o7s, 3u90—hoFTL. 4v1w—hoFTL—cryo EM. 3rav, 3rd0—hoFTL+barbiturate. Ferritin light+heavy chains: 5gn8—hFTH+Ca.

Structural alignment involves identifying corresponding residues across two (or more) polypeptide sequences by (i) modeling the structure of a first sequence using the known structure of the second sequence or (ii) comparing the structures of the first and second sequences where both are known, and identifying the residue in the first sequence most similarly positioned to a residue of interest in the second sequence. Corresponding residues are identified in some algorithms based on alpha-carbon distance minimization in the overlaid structures (e.g., what set of paired alpha carbons provides a minimized root-mean-square deviation for the alignment). When identifying positions in a non-*H. pylori* ferritin corresponding to positions described with respect to *H. pylori* ferritin, *H. pylori* ferritin can be the "second" sequence. Where a non-*H. pylori* ferritin of interest does not have an available known structure, but is more closely related to another non-*H. pylori* ferritin that does have a known structure than to *H. pylori* ferritin, it may be most effective to model the non-*H. pylori* ferritin of interest using the known structure of the closely related non-*H. pylori* ferritin, and then compare that model to the *H. pylori* ferritin structure to identify the desired corresponding residue in the ferritin of interest. There is an extensive literature on structural modeling and alignment; representative disclosures include U.S. Pat. Nos. 6,859,736; 8,738,343; and those cited in Aslam et al., Electronic Journal of Biotechnology 20 (2016) 9-13. For discussion of modeling a structure based on a known related structure or structures, see, e.g., Bordoli et al., Nature Protocols 4 (2009) 1-13, and references cited therein.

B. Immune-Stimulatory Moieties; Adjuvants; Conjugated Non-Ferritin Polypeptides

In some embodiments, a non-ferritin polypeptide and/or an immune-stimulatory moiety, such as an adjuvant, is attached to a surface-exposed amino acid. In some embodiments, the surface-exposed amino acid is a cysteine, e.g., resulting from a mutation discussed above. In some embodiments, the surface-exposed amino acid is a lysine, aspartate, or glutamate. Conjugation procedures using glutaraldehyde (for conjugation of a lysine with an amino-bearing linker or moiety) or a carbodiimide (e.g., 1-Cyclohexyl-3-(2-morpholin-4-yl-ethyl) carbodiimide or 1-Ethyl-3-(3-dimethyl-aminopropyl) carbodiimide (EDC; EDAC) for conjugating an aspartate or glutamate to an amino-bearing linker or moiety, or a lysine to a carboxyl-bearing linker or moiety) are described in, e.g., Chapter 4 of Holtzhauer, M., Basic Methods for the Biochemical Lab, Springer 2006, ISBN 978-3-540-32785-1, available from www.springer.com.

In some embodiments, an immune-stimulatory moiety, such as an adjuvant, is attached to a surface-exposed amino acid of ferritin. In some embodiments, more than one immune-stimulatory moiety, such as an adjuvant, is attached to a surface-exposed amino acid of ferritin. In some embodiments, twenty-four immune-stimulatory moieties are attached to a ferritin multimer or particle (e.g., one moiety for each monomer in the *H. pylori* ferritin particle). In some embodiments with multiple immune-stimulatory moieties attached to a ferritin nanoparticle, all of the immune-stimulatory moieties are identical. In some embodiments with multiple immune-stimulatory moieties attached to a ferritin nanoparticle, all of the immune-stimulatory moieties are not identical.

1. Types of Immune-Stimulatory Moieties; Adjuvants

Any immune-stimulatory moiety that can be attached to a surface-exposed amino acid (e.g., cysteine) can be used in ferritins according to this disclosure. In some embodiments, the immune-stimulatory moiety is a B cell agonist.

In some embodiments, the immune-stimulatory moiety is not hydrophobic. In some embodiments, the immune-stimulatory moiety is hydrophilic. In some embodiments, the immune-stimulatory moiety is polar. In some embodiments, the immune-stimulatory moiety is capable of hydrogen bonding or ionic bonding, e.g., comprises a hydrogen bond donor, hydrogen bond acceptor, cationic moiety, or anionic moiety. A moiety is considered cationic or anionic if it would be ionized in aqueous solution at a physiologically relevant pH, such as pH 6, 7, 7.4, or 8.

In some embodiments, the immune-stimulatory moiety is an adjuvant. In some embodiments, the adjuvant comprises a pathogen associated molecular pattern (PAMP). In some embodiments, the adjuvant is a toll-like receptor (TLR) agonist or stimulator of interferon genes (STING) agonist. In some embodiments, the adjuvant activates TLR signaling in B and/or T cells. In some embodiments, the adjuvant regulates the adaptive immune response.

a) TLR2 Agonists

In some embodiments, the immune-stimulatory moiety is a TLR2 agonist. In some embodiments, the immune-stimulatory moiety stimulates TLR2 signaling. In some embodiments, the immune-stimulatory moiety is a synthetic small molecule ligand of TLR2. In some embodiments, the immune-stimulatory moiety is a synthetic small molecule agonist of TLR2 signaling.

In some embodiments, the TLR2 agonist is PAM2CSK4, FSL-1, or PAM3CSK4.

b) TLR7/8 Agonists

In some embodiments, the immune-stimulatory moiety is a TLR7 and/or TLR8 agonist (i.e., an agonist of at least one of TLR7 and TLR8). In some embodiments, the immune-stimulatory moiety stimulates TLR7 and/or TLR8 signaling. In some embodiments, the immune-stimulatory moiety is a synthetic small molecule ligand of TLR7 and/or TLR8. In some embodiments, the immune-stimulatory moiety is a synthetic small molecule agonist of TLR7 and/or TLR8 signaling.

In some embodiments, the TLR7 and/or TLR8 agonist is single-stranded (ssRNA). In some embodiments, the TLR7 and/or TLR8 agonist is an imidazoquinoline. In some embodiments, the TLR7 and/or TLR8 agonist is a nucleoside analog.

In some embodiments, the TLR7 and/or TLR8 agonist is an imidazoquinolinamine Toll-like receptor (TLR) agonist, such as 3M-012 (3M Pharmaceuticals). The structure of free 3M-012 is:

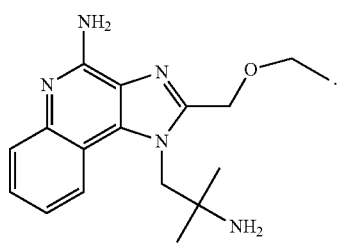

3M-012

It is understood that an immune-stimulatory moiety such as 3M-012 or any moiety discussed herein can be conjugated to a ferritin by substituting an appropriate peripheral atom of the moiety (e.g., a hydrogen) with a bond to a ferritin described herein, e.g., at the sulfur of a surface-exposed cysteine or a linker attached to such a sulfur. Thus, when conjugated to a ferritin, the structure of the immune-stimulatory moiety will differ slightly from the structure of the free molecule.

In some embodiments the TLR7 and/or TLR8 agonist is SM 7/8a. The structure of free SM 7/8a is:

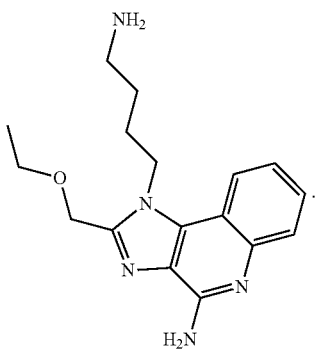 [SMILES: CCOCc1nc2c(N)nc3ccccc3c2n1CCCCN]

See, e.g., Nat Biotechnol. 2015 Nov; 33(11):1201-10. doi: 10.1038/nbt.3371.

c) TLR9 Agonists

In some embodiments, the immune-stimulatory moiety is a TLR9 agonist. In some embodiments, the immune-stimulatory moiety stimulates TLR9 signaling. In some embodiments, the immune-stimulatory moiety is a synthetic small molecule ligand of TLR9. In some embodiments, the immune-stimulatory moiety is a synthetic small molecule agonist of TLR9 signaling.

In some embodiments, the TLR9 agonist is a CpG oligodeoxynucleotide (ODN). In some embodiments, the TLR9 agonist is an unmethylated CpG ODN. In some embodiments, the CpG ODN comprises a partial or complete phosphorothioate (PS) backbone instead of the natural phosphodiester (PO) backbone found in ordinary DNA.

In some embodiments, the CpG ODN is a Class B ODN, which comprises one or more 6mer CpG motif comprising 5' Purine (Pu)-Pyrimidine (Py)-C-G-Py-Pu 3'; has a fully phosphorothioated (i.e., PS-modified) backbone; and has a length of 18-28 nucleotides. In some embodiments, the CpG ODN comprises the sequence of SEQ ID NO: 210, optionally comprising phosphorothioate linkages in the backbone.

In some embodiments, the TLR9 agonist comprises an immune-stimulatory sequence (ISS). In some embodiments the TLR9 agonist is ISS-1018 (Dynavax) (SEQ ID NO: 210).

d) STING Agonists

In some embodiments, the immune-stimulatory moiety is a STING (Stimulator of Interferon Genes Protein, also known as Endoplasmic Reticulum IFN Stimulator) agonist. In some embodiments, the immune-stimulatory moiety stimulates STING signaling. In some embodiments, the immune-stimulatory moiety is a synthetic small molecule ligand of STING. In some embodiments, the immune-stimulatory moiety is a synthetic small molecule agonist of STING signaling.

In some embodiments the STING agonist is a cyclic dinucleotide (CDN). See, e.g., Danilchanka et al., Cell 154:962-970 (2013). Exemplary CDNs include cdA, cdG, cAMP-cGMP, and 2'-5',3'-5' cGAMP (see Danilchanka et al. for structures). STING agonists also include synthetic agonists such as DMXAA

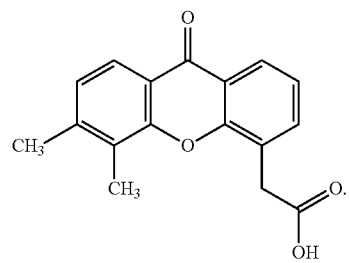 [SMILES: Cc1ccc2c(=O)c3cccc(CC(=O)O)c3oc2c1C]

2. Conjugated Non-Ferritin Polypeptides

In some embodiments, a non-ferritin polypeptide is conjugated to a surface-exposed amino acid of ferritin. In some embodiments, the non-ferritin polypeptide is a polypeptide from a pathogen and renders the ferritin protein antigenic. In some embodiments, the non-ferritin polypeptide is antigenic alone, whereas in some embodiments, the non-ferritin polypeptide is antigenic because of its association with ferritin. In some embodiments, the non-ferritin polypeptide is any one of the non-ferritin polypeptides described herein.

3. Conjugation

In some embodiments, a surface-exposed cysteine (e.g., resulting from a mutation described herein) or a cysteine in a peptide linker attached to ferritin (e.g., N-terminally to ferritin) is used to conjugate an immune-stimulatory moiety, such as an adjuvant, or a non-ferritin polypeptide to a ferritin. In some embodiments, a linker is conjugated to such a cysteine, which linker can be subsequently conjugated to an immune-stimulatory moiety, such as an adjuvant, or a non-ferritin polypeptide. In some embodiments, such a cysteine creates a chemical handle for conjugation reactions to attach an adjuvant, linker, or a non-ferritin polypeptide. In some embodiments, bioconjugates are produced, wherein an immune-stimulatory moiety, such as an adjuvant, or a non-ferritin polypeptide is linked to a ferritin after reduction of such a cysteine. In some embodiments, the cysteine is an unpaired surface-exposed cysteine, i.e., that lacks a partner cysteine in an appropriate position to form a disulfide bond. In some embodiments, the cysteine is an unpaired cysteine that comprises a free thiol side chain.

a) Types of Conjugation Chemistries

Any type chemistry can be used to conjugate the immune-stimulatory moiety, such as an adjuvant, or a non-ferritin polypeptide to the ferritin, e.g., via reaction a surface-exposed amino acid such as cysteine or another amino acid such as Lys, Glu, or Asp.

In some embodiments, the conjugation is performed using click chemistry. As used herein, "click chemistry" refers to a reaction between a pair of functional groups that rapidly and selective react (i.e., "click") with each other. In some embodiments, the click chemistry can be performed under mild, aqueous conditions. In some embodiments, a click chemistry reaction takes advantage of a cysteine on the surface of the ferritin, such as a cysteine resulting from mutation of a surface-exposed amino acid, to perform click chemistry using a functional group that can react with the cysteine.

A variety of reactions that fulfill the criteria for click chemistry are known in the field, and one skilled in the art could use any one of a number of published methodologies (see, e.g., Hein et al., Pharm Res 25(10):2216-2230 (2008)). A wide range of commercially available reagents for click chemistry could be used, such as those from Sigma Aldrich, Jena Bioscience, or Lumiprobe. In some embodiments, conjugation is performed using click chemistry as described in the Examples below.

In some embodiments, the click chemistry reaction occurs after reduction of the ferritin.

In some embodiments, the click chemistry may be a 1-step click reaction. In some embodiments, the click chemistry may be a 2-step click reaction.

In some embodiments, the reaction(s) comprises metal-free click chemistry. In some embodiments, the reaction(s) comprise thiol-maleimide and/or disulfide exchange.

Metal Free Click Chemistry

Metal-free click chemistry can be used for conjugation reactions to avoid potential oxidation of proteins. Metal-free click chemistry has been used to form antibody conjugates (see van Geel et al., Bioconjugate Chem. 2015, 26, 2233-2242).

In some embodiments, metal-free click chemistry is used in reactions to attach adjuvant to ferritin. In some embodiments, copper-free conjugation is used in reactions to attach adjuvant to ferritin. In some embodiments, the metal-free click chemistry uses bicyclo[6.1.0]nonyne (BCN). In some embodiments, the metal-free click chemistry uses dibenzo-azacyclooctyne (DBCO). In some embodiments BCN or DBCO reacts with an azide group.

DBCO has high specificity for azide groups via a strain-promoted click reaction in the absence of a catalyst, resulting in high yield of a stable triazole. In some embodiments, DBCO reacts with azide in the absence of copper catalyst.

In some embodiments, metal-free click chemistry is used in a 1-step click reaction. In some embodiments, metal-free click chemistry is used in a 2-step click reaction.

Thiol-Maleimide and Disulfide Exchange

Ferritins described herein can comprise a cysteine comprising a thiol, also known as a sulfhydryl, which is available for reaction with sulfhydryl-reactive chemical groups (or which can be made available through reduction). Thus, the cysteine allows chemoselective modification to add an immune-stimulatory moiety, such as an adjuvant, to the ferritin. Under basic conditions, the cysteine will be deprotonated to generate a thiolate nucleophile, which can react with soft electrophiles, such as maleimides and iodoacetamides. The reaction of the cysteine with a maleimide or iodoacetamide results in a carbon-sulfur bond.

In some embodiments, a sulfhydryl-reactive chemical group reacts with the surface-exposed cysteine or cysteine in the linker of the ferritin. In some embodiments, the sulfhydryl-reactive chemical group is a haloacetyl, maleimide, aziridine, acryloyl, arylating agent, vinylsulfone, pyridyl disulfide, or TNB-thiol.

In some embodiments, the sulfhydryl-reactive chemical group conjugates to the sulfhydryl of the cysteine by alkylation (i.e., formation of a thioether bond)). In some embodiments, the sulfhydryl-reactive chemical group conjugates to the sulfhydryl of the cysteine by disulfide exchange (i.e., formation of a disulfide bond).

In some embodiments, the reaction to conjugate an immune-stimulatory moiety, such as an adjuvant, to the ferritin is a thiol-maleimide reaction.

In some embodiments, the sulfhydryl-reactive chemical group is a maleimide. In some embodiments, reaction of a maleimide with the cysteine results in formation of a stable thioester linkage, e.g., that is not reversible. In some embodiments, the maleimide does not react with tyrosines, histidines, or methionines in the ferritin. In some embodiments, unreacted maleimides are quenched at the end of the reaction by adding a free thiol, e.g., in excess.

In some embodiments, the reaction to conjugate an immune-stimulatory moiety, such as an adjuvant, to the ferritin is a thiol-disulfide exchange, also known as a disulfide interchange. In some embodiments, the reaction involves formation of a mixed disulfide comprising a portion of the original disulfide. In some embodiments, the original disulfide is the cysteine introduced in the ferritin by mutation of a surface-exposed amino acid or addition of an N-terminal linker.

In some embodiments, the sulfhydryl-reactive chemical group is a pyridyl dithiol. In some embodiments, the sulfhydryl-reactive chemical group is a TNB-thiol group.

b) Linkers for Conjugation

In some embodiments, an immune-stimulatory moiety, such as an adjuvant, or a non-ferritin polypeptide is attached to the ferritin via a linker that is covalently bound to a surface-exposed amino acid such as a cysteine. In some embodiments, the linker comprises a polyethylene glycol, e.g., a PEG linker. In some embodiments, the polyethylene glycol (e.g., PEG) linker increases water solubility and ligation efficiency of the ferritin linked to the immune-stimulatory moiety, such as an adjuvant. The PEG linker is between 2 and 18 PEGs long, e.g., PEG4, PEG5, PEG6, PEG7, PEG8, PEG9, PEG10, PEG11, PEG12, PEG13, PEG14, PEG15, PEG16, PEG17, and PEG18.

In some embodiments, the linker comprises a maleimide. In some embodiments, the linker comprises the components of immune-stimulatory moiety (ISM)-linker-maleimide. In some embodiments, the ISM-linker-maleimide is conjugated to ferritin in a 1-step click chemistry reaction by reaction of the maleimide with a cysteine of the ferritin. In some embodiments, the ISM of the adjuvant-linker-maleimide is SM7/8a. In some embodiments, the linker of the ISM-linker-maleimide is PEG4. In some embodiments, the ISM-linker-maleimide is SM7/8a-PEG4-maleimide.

In some embodiments, a 2-step click chemistry protocol is used with a linker comprising a sulfhydryl-reactive chemical group at one end and an amine-reactive group at the other end. In such a 2-step click chemistry protocol, a sulfhydryl-reactive chemical group reacts with a cysteine of the ferritin, while the amine-reactive group reacts with a reagent attached to the ISM. In this way, the ISM is conjugated to the ferritin via a set of 2 click chemistry reagents.

In some embodiments of the 2-step click chemistry protocol, the sulfhydryl-reactive chemical group is maleimide. In some embodiments of the 2-step click chemistry protocol, the maleimide reacts with the cysteine introduced in the ferritin by mutation of a surface-exposed amino acid or addition of an N-terminal linker.

In some embodiments of the 2-step click chemistry protocol, the amine-reactive group is DBCO. In some embodiments of the 2-step click chemistry protocol, the DBCO reacts with an azide group attached to an ISM.

In some embodiments, a maleimide-linker-DBCO is used. In some embodiments, the maleimide-linker-DBCO is conjugated to ferritin after the ferritin is reduced. In some embodiments, the maleimide-linker-reagent is conjugated to ferritin by reaction of the maleimide with the cysteine of the ferritin in a first step. In some embodiments, the DBCO is used to link to an ISM attached to azide. In some embodiments, the ISM coupled to azide is ISS-1018. In some embodiments, the adjuvant coupled to azide is 3M-012 or CpG.

In some embodiments, a linker with a reactive group is added to the ISM. In some embodiments, the linker is a PEG4-azide linker or a PEG4-maleimide linker.

In some embodiments, a PEG4-azide linker is conjugated to 3M-012. An exemplary structure of 3M-012 conjugated to a PEG4-azide linker is:

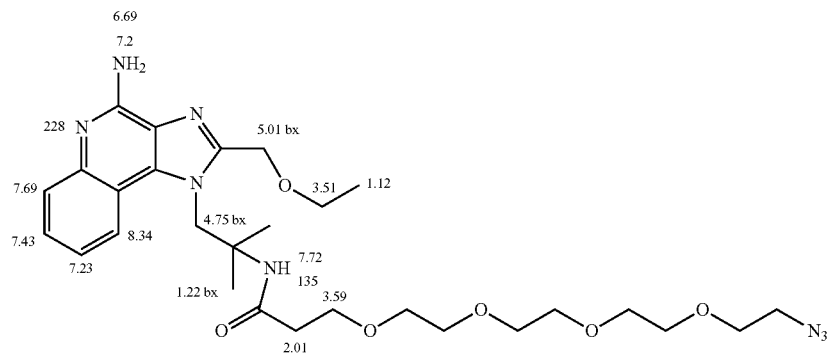 [SMILES: CCOCc1nc2c(N)nc3ccccc3c2n1CC(C)(C)NC(=O)CCOCCOCCOCCOCCN=[N+]=[N-]]

In some embodiments, a PEG4-azide linker is conjugated to SM7/8a. An exemplary structure of SM7/8a conjugated to a PEG4-azide linker is:

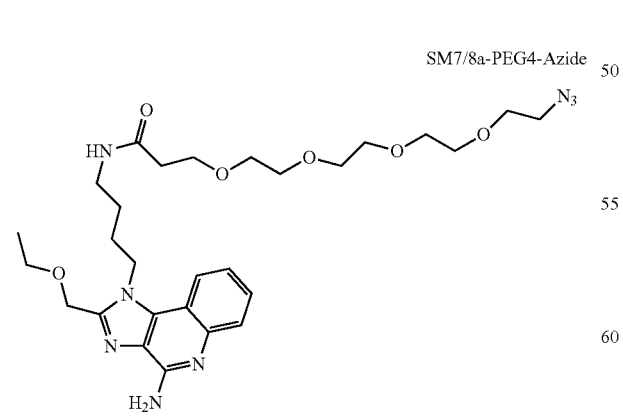

In some embodiments, a PEG4-maleimide linker is conjugated to SM7/8a. An exemplary structure of SM7/8a conjugated to a PEG4-maleimide linker is:

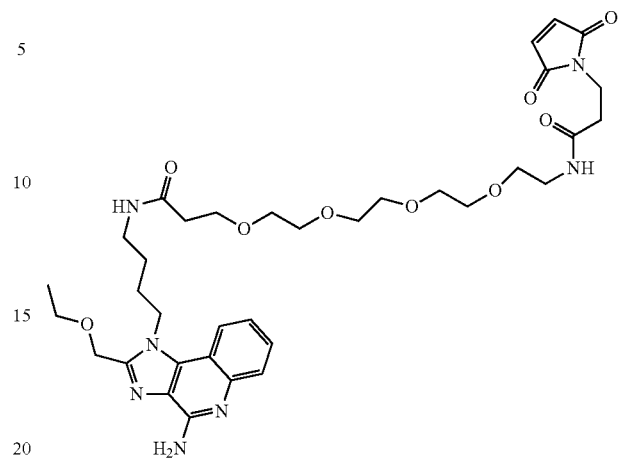

In some embodiments, an azide group is conjugated to ISS-1018. An exemplary structure of ISS-1018 conjugated to an NHS ester-azide linker is:

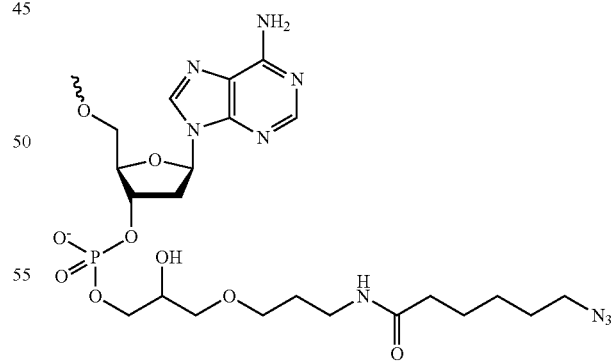

C. Antigenic Ferritin Polypeptides

In some embodiments, a ferritin described herein is part of an antigenic ferritin polypeptide further comprising a non-ferritin polypeptide. In some embodiments, the antigenic ferritin polypeptide is a fusion protein comprising a ferritin coupled to a non-ferritin polypeptide. In some embodiments, the non-ferritin polypeptide is fused to the N-terminus of the ferritin. In some embodiments, the non-ferritin polypeptide is fused to the C-terminus of the ferritin. The non-ferritin polypeptide can also be conjugated to the ferritin as discussed above, e.g., via a cysteine resulting from mutation of a surface-exposed amino acid or introduced in an N- or C-terminal linker.

1. Linkers

In some embodiments, a linker separates the amino acid sequence of the non-ferritin polypeptide from the amino acid sequence of ferritin. Any linker may be used. In some embodiments, the linker is a peptide linker, which can facilitate expression of the antigenic ferritin polypeptide as a fusion protein (e.g., from a single open reading frame). In some embodiments, the linker is a glycine-serine linker. In some embodiments, the glycine-serine linker is GS, GGGS (SEQ ID NO: 443), 2×GGGS (i.e., GGGSGGGS) (SEQ ID NO: 444), or 5×GGGS (SEQ ID NO: 445). The linker may be N- or C-terminal to ferritin.

In some embodiments, the linker is 2, 3, 4, 5, 6, 7, 8, 9, or 10 amino acids in length. In some embodiments, the linker is about 2-4, 2-6, 2-8, 2-10, 2-12, or 2-14 amino acids in length. In some embodiments, the linker is at least 15 amino acids in length. In some embodiments, the linker is at least 25 amino acids in length. In some embodiments, the linker is at least 30 amino acids in length. In some embodiments, the linker is at least 35 amino acids in length. In some embodiments, the linker is at least 40 amino acids in length. In some embodiments, the linker is less than or equal to 60 amino acids in length. In some embodiments, the linker is less than or equal to 50 amino acids in length. In some embodiments, the linker is about 16, 28, 40, 46, or 47 amino acids in length. In some embodiments, the linker is flexible. In some embodiments, the linker comprises a cysteine, e.g., for use as a site for conjugation of an immune-stimulatory moiety (e.g., adjuvant); an exemplary linker comprising a cysteine is provided as SEQ ID NO: 225. In some embodiments, the linker comprises a sequence with at least 75%, 80%, 85%, 90%, or 95% identity to SEQ ID NO: 225, and further comprises a cysteine corresponding to the cysteine in SEQ ID NO: 225. In some embodiments, the linker comprises at least 25 amino acids (e.g., 25 to 60 amino acids), wherein a cysteine is located at a position ranging from the 8$^{th}$ amino acid from the N-terminus to the 8$^{th}$ amino acid from the C-terminus, or within 10 amino acids of the central residue or bond of the linker.

In some embodiments, the linker comprises glycine (G) and/or serine (S) amino acids. In some embodiments, the linker comprises or consists of glycine (G), serine (S), asparagine (N), and/or alanine (A) amino acids, and optionally a cysteine as discussed above. In some embodiments, the linker comprises an amino acid sequence with at least 80%, 85%, 90%, 95%, 97%, 98%, 99%, or 100% identity to SEQ ID NO: 222. In some embodiments, the linker comprises GGGGSGGGGSGGGGSG (SEQ ID NO: 220), GGSGSGSNSSASSGASSGGASGGSGGSG (SEQ ID NO: 221), GGSGSASSGASASGSSNGSGSGSGSNSSASS-GASSGGASGGSGGSG (SEQ ID NO: 222), or GS. In some embodiments, the linker comprises FR1 (SEQ ID NO: 223) or FR2 (SEQ ID NO: 224). In some embodiments, the linker comprises SEQ ID NO: 233-238.

In some embodiments, the ferritin comprises *H. pylori* ferritin with the amino terminal extension of bullfrog ferritin (which will be referred to as hybrid ferritin). In some embodiments, this hybrid ferritin forms multimers with non-ferritin polypeptide-attachment sites distributed evenly on the surface (see Kanekiyo 2015). In some embodiments, N-terminal fusion proteins with hybrid ferritin allow presentation of a non-ferritin polypeptide on the ferritin nanoparticle surface. In some embodiments, the non-ferritin polypeptide is a viral or bacterial polypeptide. In some embodiments, a ferritin comprises a glutamate at a position corresponding to position 13 of SEQ ID NO: 208 (hybrid ferritin, which comprises this glutamate) or position 6 in SEQ ID NO: 209 (wild-type *H. pylori* ferritin, in which position 6 is isoleucine). In combination with a bullfrog linker, this glutamate is thought to preserve the conserved salt bridge found in human and bullfrog ferritins (6R and 14E in both human light chain and bullfrog lower-subunit ferritins). See Kanekiyo et al., Cell 162, 1090-1100 (2015)).

In some embodiments, a non-ferritin polypeptide is linked to ferritin via a cysteine-thrombin-histidine linker. In some embodiments, this linker is used to directly conjugate a moiety (e.g., immune-stimulatory moiety or non-ferritin polypeptide) to ferritin via click chemistry. An exemplary sequence comprising a cysteine-thrombin-histidine linker is SEQ ID NO: 218. Click chemistry suitable for conjugation reactions involving the cysteine-thrombin-histidine linker is discussed above.

In some embodiments, a linker comprising a cysteine as a conjugation site for an immune-stimulatory moiety such as an adjuvant is used in a construct comprising a ferritin molecule lacking an unpaired, surface-exposed cysteine, or in a construct comprising a ferritin molecule comprising an unpaired, surface-exposed cysteine.

In some embodiments, a construct does not comprise a linker. In some embodiments, a construct comprises one linker. In some embodiments, a construct comprises two or more than two linkers.

Representative pathogens (viruses and bacteria) that may be used as sources of non-ferritin polypeptides for incorporation into antigenic ferritin polypeptides include Epstein Barr virus (EBV), influenza, *Borrelia* (e.g., *Borrelia* species that cause Lyme disease, such as *B. burgdorferi*), and Respiratory Syncytial virus (RSV). In some embodiments, the non-ferritin polypeptide from the pathogen comprises a peptide sequence from a protein expressed or encoded by the pathogen. In some embodiments, the amino acids of the non-ferritin polypeptide are linked to the amino acid sequence of hybrid ferritin, with the non-ferritin polypeptide sequence preceding the N-terminal extension of the bullfrog ferritin.

In some embodiments, attachment of amino acids of non-ferritin polypeptides to the amino acid sequence of hybrid ferritin generates a fusion protein. In some embodiments, this fusion protein comprises hybrid ferritin together with a non-ferritin polypeptide in such a way that the non-ferritin polypeptide is present on each monomer of ferritin. In some embodiments, these monomers self-assemble into a ferritin nanoparticle. In some embodiments, a ferritin nanoparticle comprising hybrid ferritin monomers comprises multiple copies of the non-ferritin polypeptide on the nanoparticle surface. In some embodiments, assembly of twenty-four hybrid ferritin monomers forms a ferritin nanoparticle with twenty-four non-ferritin polypeptides on the surface of the nanoparticle.

In some embodiments, the antigenic ferritin polypeptide comprises the sequence of any one of SEQ ID NOS: 1-76, 301-343, 401-403, 410, 413-414, 417-427 or 501-523. In some embodiments, the fusion protein comprises a sequence with at least 80%, 85%, 90%, 95%, 98%, or 99% identity to any of the foregoing sequences, wherein the ferritin sequence comprises a mutation replacing a surface-exposed amino acid with a cysteine. Such a ferritin sequence can further comprise an Asn to Glu mutation at a position that corresponds to position 19 of free *H. pylori* ferritin (SEQ ID NO: 208), and/or a Cys to Ser mutation at a position that corresponds to position 31 of free *H. pylori* ferritin (SEQ ID NO: 208). In some embodiments, the cysteine resulting from the mutation of the surface-exposed amino acid corresponds to any of the cysteine positions disclosed herein, e.g., position 12, 26, 72, 75, 79, 100, or 111 of *H. pylori* ferritin.

2. EBV Polypeptides as Non-Ferritin Polypeptides

In some embodiments, a ferritin polypeptide described herein further comprises an EBV polypeptide. In some embodiments, the non-ferritin polypeptide of an antigenic ferritin polypeptide described herein is an EBV polypeptide. In some embodiments, an antigenic ferritin polypeptide described herein is also an antigenic EBV polypeptide.

a) EBV Polypeptides Comprising gL and gH Polypeptides

EBV has three glycoproteins, glycoprotein B (gB), gH, and gL, that form the core membrane fusion machinery to allow viral penetration into a cell. gL and gH have been previously described, for example, in Matsuura et al., Proc Natl Acad Sci USA. 2010 Dec. 28; 107(52):22641-6. Monomers and trimers of gL and gH for use as vaccines have been described, for example, in Cui et al., Vaccine. 2016 Jul. 25; 34(34):4050-5. The gH and gL proteins associate to form a heterodimeric complex considered necessary for efficient membrane fusion and binding to epithelial cell receptors required for viral entry.

In some embodiments, the EBV polypeptide comprises EBV gL and EBV gH. In some embodiments, the polypeptide exists as a single-chain. In some embodiments, the polypeptide forms a nanoparticle (e.g., ferritin or lumazine synthase particle), e.g., through multimerization of a ferritin or lumazine synthase. In some embodiments, an antigenic EBV polypeptide according to this disclosure comprises an EBV gL polypeptide and an EBV gH polypeptide, and a linker having a length of at least 15 amino acids separating the EBV gL polypeptide and the EBV gH polypeptide. It has been found that a relatively long linker can provide benefits such as improved expression and/or immunogenicity.

In some embodiments, the EBV gH and/or gL polypeptides comprise full-length gH and/or gL (for exemplary full-length sequences, see GenBank Accession Nos. CEQ35765.1 and YP_001129472.1, respectively). In some embodiments, the EBV gH and/or gL polypeptides are fragments of gH and/or gL. In some embodiments, the gL polypeptide is a gL(D7) construct with a 7-amino acid deletion at the end of the gL C terminus. In some embodiments, the gH polypeptide comprises a mutation at C137, such as a C137A mutation. In some embodiments, the C137 mutation removes a native, unpaired cysteine to avoid non-specific conjugation. In some embodiments, the gH polypeptide comprises a mutation to remove a cysteine corresponding to cysteine 137 of SEQ ID NO: 437, such as a C137A mutation. In some embodiments, the C137 mutation removes a native, unpaired cysteine to avoid non-specific conjugation.

In some embodiments, the EBV gL polypeptide comprises an amino acid sequence with at least 80%, 85%, 90%, 95%, 97%, 98%, 99%, or 100% identity to SEQ ID NO: 436. In some embodiments, the EBV gH polypeptide comprises an amino acid sequence with at least 80%, 85%, 90%, 95%, 97%, 98%, 99%, or 100% identity to SEQ ID NO: 437.

In some embodiments, a mammalian leader sequence (also known as a signal sequence) is appended N-terminally to an EBV polypeptide such as a gH or gL polypeptide, e.g., at the N-terminus of the polypeptide. In some embodiments, a mammalian leader sequence results in secretion of a protein when expressed in mammalian cells.

Native EBV gH and/or gL sequences are shown in GenBank Accession No. NC_009334.1 (Human herpesvirus 4, complete genome, dated 26 Mar. 2010). Full length or fragmented native EBV gH and/or gL may be utilized as the non-ferritin polypeptide. For some of the constructs disclosed herein, amino acids 23-137 of the gL amino acid sequence in NC_009334.1 was used as the gL polypeptide, and the native signal peptide (amino acids 1-22 of the NCBI sequence) was replaced with an IgG K leader sequence. For some of the constructs, amino acids 19-678 of the gH amino acid sequence in NC_009334.1 was used as the gH polypeptide. In some embodiments, the gL and gH were linked via a linker as shown in the table of sequences herein.

In some embodiments, gL and gH polypeptides are expressed as a single-chain monomer. In some embodiments, the monomer composition comprises or consists of a sequence shown in the Sequence Table and denoted in the description as "monomer". A single-chain comprising gL and gH polypeptides may be referred to as "gL/gH," which can be used interchangeably with "gH_gL," "gL_gH," or "gL/gH."

The gL/gH polypeptide can be combined with any of the ferritins or lumazine synthases discussed herein. For example, in some embodiments, an antigenic EBV polypeptide comprises a monomer or trimer gL/gH polypeptide (+/−gp42 and/or gp220) and i) a heavy or light chain ferritin (e.g., *T. ni* heavy or light chain ferritin); or ii) a ferritin, optionally comprising a surface-exposed cysteine.

Additionally, in some embodiments, any antigenic EBV polypeptide comprising an EBV gL/gH polypeptide and a ferritin can be present in a composition comprising another polypeptide disclosed herein, such as another antigenic EBV polypeptide comprising a ferritin and an EBV polypeptide other than gL/gH, e.g., gp220 and/or gp42.

b) EBV Polypeptides Comprising a Gp220 Polypeptide

In some embodiments, the EBV polypeptide comprises a gp220 polypeptide. A gp220-hybrid bullfrog/*H. pylori* ferritin nanoparticle has been previously described in Kanekiyo Cell. 2015 Aug. 27; 162(5):1090-100. This nanoparticle did not comprise a mutation providing a surface-exposed cysteine or a linker comprising a cysteine, among other differences from certain ferritins described herein.

In some embodiments, the gp220 polypeptide comprises an amino acid sequence with at least 80%, 85%, 90%, 95%, 97%, 98%, 99%, or 100% identity to SEQ ID NO: 438.

In some embodiments, a mammalian leader sequence (also known as a signal sequence) is N-terminally appended to a gp220 polypeptide. In some embodiments, a mammalian leader sequence results in secretion of a protein when expressed in mammalian cells.

The gp220 polypeptide can be combined with any of the ferritins or lumazine synthases discussed herein. For example, in some embodiments, an antigenic EBV polypeptide comprises a gp220 polypeptide (+/−gL/gH and/or gp42) and i) a heavy or light chain ferritin (e.g., *T. ni* heavy or light chain ferritin); or ii) a ferritin, optionally comprising a surface-exposed cysteine as described herein.

Additionally, in some embodiments, any antigenic EBV polypeptide comprising a gp220 polypeptide and a ferritin can be present in a composition comprising another polypeptide disclosed herein, such as another antigenic EBV polypeptide comprising a ferritin and an EBV polypeptide other than gp220, e.g., gL/gH and/or gp42.

c) EBV Polypeptides Comprising a Gp42 Polypeptide

In some embodiments, the EBV polypeptide comprises a gp42 polypeptide. An exemplary gp42 sequence is provided as SEQ ID NO: 434. A further exemplary gp42 sequence, suitable for inclusion in fusions e.g. with gL and gH polypeptides, is provided as SEQ ID NO: 239. Another exemplary gp42 sequence, suitable for inclusion in fusions e.g. with gL and gH polypeptides, is provided as SEQ ID NO: 240.

In some embodiments, the gp42 polypeptide comprises an amino acid sequence with at least 80%, 85%, 90%, 95%, 97%, 98%, 99%, or 100% identity to SEQ ID NO: 434. In some embodiments, the gp42 polypeptide comprises an amino acid sequence with at least 80%, 85%, 90%, 95%, 97%, 98%, 99%, or 100% identity to SEQ ID NO: 239. In some embodiments, the gp42 polypeptide comprises an amino acid sequence with at least 80%, 85%, 90%, 95%, 97%, 98%, 99%, or 100% identity to SEQ ID NO: 240.

In some embodiments, a mammalian leader sequence (also known as a signal sequence) is N-terminally appended to a gp42 polypeptide. In some embodiments, a mammalian leader sequence results in secretion of a protein when expressed in mammalian cells. An exemplary leader sequence is amino acids 1-22 of SEQ ID NO: 226.

In some embodiments, an antigenic EBV polypeptide comprising a gH and/or gL polypeptide further comprises a gp42 polypeptide. Any of the EBV polypeptides comprising a gH and/or gL polypeptide described above can further comprise a gp42 polypeptide. In some embodiments, the gp42 polypeptide is located C-terminal to the gH and/or gL polypeptide(s), as exemplified in SEQ ID NOs: 421 and 226-231. In some embodiments, the gp42 polypeptide is located N-terminal to a ferritin, also as exemplified in SEQ ID NOs: 421 and 227-231. Thus, for example, an antigenic EBV polypeptide may comprise, in N- to C-terminal orientation, a gL polypeptide, a gH polypeptide, a gp42 polypeptide, and optionally a ferritin. Linkers such as those described herein can separate the gp42 polypeptide from EBV polypeptides and/or ferritins located N-terminal and/or C-terminal thereto. In some embodiments, a linker separates each EBV polypeptide in an antigenic ferritin polypeptide (e.g., a gL polypeptide, a gH polypeptide, and a gp42 polypeptide), and a further linker may be present between the ferritin if present and the EBV polypeptide proximal thereto (e.g., a gp42 polypeptide).

In some embodiments, a linker having a length of at least 15 amino acids separates the EBV gH polypeptide and the EBV gp42 polypeptide. Such a linker may have a length of 15 to 60 amino acids, 20 to 60 amino acids, 30 to 60 amino acids, 40 to 60 amino acids, 30 to 50 amino acids, or 40 to 50 amino acids. In some embodiments, the linker comprises an amino acid sequence with at least 80%, 85%, 90%, 95%, 97%, 98%, 99%, or 100% identity to SEQ ID NO: 234.

In some embodiments, where gp42 and ferritin are present in a polypeptide, a linker separates the EBV gp42 polypeptide and the ferritin. Such a linker may have a length of at least 15 amino acids or has a length of 15 to 60 amino acids, 20 to 60 amino acids, 30 to 60 amino acids, 40 to 60 amino acids, 30 to 50 amino acids, or 40 to 50 amino acids. In some embodiments, such a linker comprises an amino acid sequence with at least 80%, 85%, 90%, 95%, 97%, 98%, 99%, or 100% identity to any one of SEQ ID NOs: 233, 234, 235, 236, 237, or 238.

The gp42 polypeptide can be combined with any of the ferritins or lumazine synthases discussed herein. For example, in some embodiments, a polypeptide comprises a gp42 polypeptide (+/−gL/gH and/or gp220) and a heavy or light chain ferritin (e.g., *T. ni* heavy or light chain ferritin); or ii) ferritin, optionally comprising a surface-exposed cysteine as described herein.

In some embodiments, the antigenic EBV polypeptide comprises a sequence with at least 80%, 85%, 90%, 95%, 98%, or 99% identity to amino acids 23-1078 of SEQ ID NO: 226. In some embodiments, the antigenic EBV polypeptide comprises a sequence with 80%, 85%, 90%, 95%, 98%, or 99% identity to amino acids 1-1078 of SEQ ID NO: 226. In some embodiments, the antigenic EBV polypeptide comprises a sequence with at least 80%, 85%, 90%, 95%, 98%, or 99% identity to any one of SEQ ID NOs: 226, 227, 228, 229, 230, or 231, optionally lacking the leader sequence (e.g., lacking any or all of amino acids 1-22 of these sequences).

Additionally, in some embodiments, any antigenic EBV polypeptide comprising a gp42 polypeptide and a ferritin can be present in a composition comprising another polypeptide disclosed herein, such as another antigenic EBV polypeptide comprising a ferritin and an EBV polypeptide other than gp42, e.g., gL/gH and/or gp220.

d) Mutations in gL, gH, Gp42, Linker, and/or Ferritin Sequences to Eliminate Potential Oxidation, Deamidation, or Isoaspartate Formation Sites In some embodiments, an antigenic EBV polypeptide comprises one or more mutations to eliminate potential oxidation, deamidation, or Isoaspartate formation sites, such as the exemplary mutations set forth in Table 1 below.

For example, in some embodiments, a gL sequence comprises one or more mutations to eliminate a potential succinimide/isoaspartate or deamidation site. For example, a gL sequence can comprise a G to A mutation at a position corresponding to position 36 of SEQ ID NO: 227; an N to Q mutation at a position corresponding to position 47 of SEQ ID NO: 227; or an N to Q mutation at a position corresponding to position 105 of SEQ ID NO: 227. A position in an amino acid sequence "corresponds" to a given position in SEQ ID NO: 227 if it aligns to that position according to a standard sequence alignment algorithm such as the Smith-Waterman algorithm using default parameters.

In some embodiments, a linker comprises one or more mutations to eliminate a potential deamidation site. For example, a linker sequence can comprise an N to G mutation at a position corresponding to position 132 or 141 of SEQ ID NO: 227.

In some embodiments, a gH sequence comprises one or more mutations to eliminate a potential succinimide/isoaspartate or oxidation site. For example, a gH sequence can comprise an M to L mutation at a position corresponding to position 189, 401, or 729 of SEQ ID NO: 227; a D to E mutation at a position corresponding to position 368 of SEQ ID NO: 227; an M to I mutation at a position corresponding to position 499 or 639 of SEQ ID NO: 227; or an N to Q mutation at a position corresponding to position 653 of SEQ ID NO: 227.

In some embodiments, a gp42 sequence comprises one or more mutations to eliminate a potential deamidation site. For example, a gp42 sequence can comprise an N to Q mutation at a position corresponding to position 959 or 990 of SEQ ID NO: 227; or an N to S mutation at a position corresponding to position 988 of SEQ ID NO: 227.

In some embodiments, a ferritin sequence comprises one or more mutations to eliminate a potential deamidation, oxidation, or isoaspartate formation site. For example, a ferritin sequence can comprise a Q to S mutation at a position corresponding to position 1150 of SEQ ID NO: 227; an M to I mutation at a position corresponding to position 1168 of SEQ ID NO: 227; an M to L mutation at a position corresponding to position 1177 of SEQ ID NO: 227; a G to A mutation at a position corresponding to position 1188 of SEQ ID NO: 227; or an N to Q mutation at a position corresponding to position 1253 or 1296 of SEQ ID NO: 227.

Exemplary mutations are shown below in Table 6. The position numbering corresponds to SEQ ID NO: 227.

TABLE 6

Exemplary mutations.

| Location | Modification | START | END | MOTIF | solvent expsoure | Mutation |
|---|---|---|---|---|---|---|
| gL | Succinimide/IsoAsp | 35 | 36 | DG | Exposed | G36A |
| gL | deamidation | 47 | 47 | N | likely exposed | N47Q |
| gL | deamidation | 105 | 105 | N | exposed | N105Q |
| linker | deamidation | 132 | 132 | N | exposed | N132G |
| linker | deamidation | 141 | 141 | N | exposed | N141G |
| gH | oxidation | 189 | 189 | M | exposed | M189L |
| gH | Succinimide/IsoAsp | 368 | 369 | DY | exposed | D368E |
| gH | oxidation | 401 | 401 | M | buried | M401L |
| gH | Succinimide/IsoAsp | 429 | 430 | DT | exposed | D429E |
| gH | oxidation | 499 | 499 | M | exposed | M499I |
| gH | oxidation | 639 | 639 | M | exposed | M639I |
| gH | oxidation | 653 | 653 | N | exposed | N653Q |
| gH | oxidation | 729 | 729 | M | exposed | M729L |
| gp42 | deamidation | 959 | 959 | N | exposed | N959Q |
| gp42 | deamidation | 988 | 988 | N | exposed | N988S |
| gp42 | deamidation | 990 | 990 | N | exposed | N990Q |
| ferritin | deamidation | 1150 | 1150 | Q | exposed | Q1150S |
| ferritin | oxidation | 1168 | 1168 | M | buried | M1168I |
| ferritin | deamidation | 1177 | 1177 | M | buried | M1177L |
| ferritin | IsoAsp | 1187 | 1188 | DG | buried | G1188A |
| ferritin | deamidation | 1253 | 1253 | N | exposed | N1253Q |
| ferritin | deamidation | 1296 | 1296 | N | exposed | N1296Q |

3. Influenza Polypeptides as Non-Ferritin Polypeptides

In some embodiments, a ferritin polypeptide described herein further comprises an influenza polypeptide. In some embodiments, the non-ferritin polypeptide of an antigenic ferritin polypeptide described herein is an influenza polypeptide. In some embodiments, an antigenic ferritin polypeptide described herein is an antigenic influenza-ferritin polypeptide.

a) HA and NA Polypeptides

In some embodiments, the influenza polypeptide is an HA or NA polypeptide comprising a full or partial length HA or NA. Any HA or NA polypeptide may be used. The HA or NA polypeptide may be naturally occurring or altered from nature. In some embodiments the HA is from any one of H1-H18. In some embodiments the NA is from any one of N1-N11.

In some embodiments, the HA polypeptide comprises an HA ectodomain. The HA ectodomain may be from any subtype of influenza, including H1-H18.

In some embodiments, the HA polypeptide comprises a stem region of HA. The stem region of HA may be from any subtype of influenza, including H1-H18.

In some embodiments, the HA polypeptide is from a Type A influenza virus. The Type A influenza virus may be A/Puerto Rico/1934, A/Weiss/1/1943, A/Fort Monmouth/1/1947 (FM47), A/Malaysia/302/54 (MAL54), A/Denver/1/1957 (DV57), A/New Jersey/8/1976, A/USSR/90/1977, A/Hong Kong/117/1977 (HK77), A/Brazil/11/1978, A/Chile/1/1983, A/Taiwan/1/1986, A/Texas/36/1991, A/Beijing/262/1995, A/New Caledonia/20/1999 (NC99), A/Solomon Islands/6/2006, A/Brisbane/59/2007, A/California/07/2009 (CA09), A/Bangladesh/2021/2012, or A/Vietnam/3050/2013.

In some embodiments, the HA polypeptide is from an H1 influenza virus. In some embodiments, the H1 virus is A/South Carolina/1/18.

In some embodiments, the HA polypeptide is from an H2 influenza virus. In some embodiments, the H2 virus is the 1957 pandemic H2N2 influenza A virus.

In some embodiments, the HA polypeptide is from an H3 influenza virus. In some embodiments, the H3 influenza virus is an H3N8 virus. In some embodiments, the H3N8 virus is Equine Ohio 2003. In some embodiments, the H3N8 virus is Equine Bari 2005. In some embodiments, the H3N8 virus is Equine Aboyne 2003. In some embodiments, the H3 influenza virus is an H3N2 virus. In some embodiments, the H3N2 virus is Perth 2009. In some embodiments, the H3N2 virus is Victoria 2011.

In some embodiments, the HA polypeptide is from an H5 influenza virus. In some embodiments, the H5 influenza virus is an H5/N1 virus. In some embodiments, the H5/N1 virus is Indonesia 2005. In some embodiments, the H5/N1 virus is Bar Headed Goose 2005. In some embodiments, the H5/N1 virus is Whooper Swan 2005. In some embodiments, the H5/N1 virus is Mallard/Huadong 2003.

In some embodiments, the HA polypeptide is from an influenza Type B virus. In some embodiments, the Type B virus is Wisconsin 2010. In some embodiments, the Type B virus is Massachusetts 2012. In some embodiments, the Type B virus is Phuket 2013. In some embodiments, the Type B virus is Brisbane 2008. In some embodiments, the Brisbane 2008 sequence comprises a D197N mutation. This mutation was found to improve expression of this nanoparticle and it is a naturally occurring mutation in other strains, such as B/Brisbane/2009 and B/Phuket/2013. This amino acid may be involved in contacting sialic acid receptors.

In some embodiments, the HA polypeptide comprises a Computationally Optimized Broadly Reactive Antigen (COBRA) generated following examples of Giles B M and Ross T M, Vaccine 29(16):3043-54 (2011) or Carter D M, et al., J Virol 90:4720-4734 (2016).

In some embodiments, a COBRA sequence is generated from human H1N1 influenza sequences. In some embodiments, a COBRA sequence is generated from human H1N1 influenza sequences spanning 1999-2012. An exemplary COBRA sequence generated from human H1N1 influenza sequences spanning 1999-2012 is COBRA X6, comprised in SEQ ID NO: 329. In some embodiments, a COBRA sequence is generated from human H1N1 strains spanning 1933-1957 and 2009-2011 plus swine H1N1 influenza strains from 1931-1998. An exemplary COBRA sequence generated from human H1N1 strains spanning 1933-1957 and 2009-2011 plus swine H1N1 influenza strains from 1931-1998 is COBRA P1, comprised in SEQ ID NO: 327.

In some embodiments, the COBRA sequence is X3. In some embodiments, the COBRA sequence is hCOBRA-2 generated from H5N1.

A mutation to eliminate the HA receptor binding site (Y98F) was described in Whittle et al., Journal of Virology 11(8):4047-4057 (2014). In some embodiments, the HA polypeptide comprises a Y98F mutation. Any of the HAs noted above can be modified to comprise a Y98F mutation. In some embodiments, the HA is from a H1/New Caledonia/1999 (NC99) virus and comprises a Y98F mutation.

4. *Borrelia* and OspA Polypeptides as Non-Ferritin Polypeptides

In some embodiments, a ferritin polypeptide described herein further comprises a *Borrelia* polypeptide. In some embodiments, the non-ferritin polypeptide of an antigenic ferritin polypeptide described herein is a *Borrelia* polypeptide. In some embodiments, the *Borrelia* polypeptide is from *B. burgdorferi*. In some embodiments, the *Borrelia* polypeptide is from a *Borrelia* species corresponding to serotype 1, 2, 3, 4, 5, 6, or 7. In some embodiments, the *Borrelia* can be carried by a tick of the *Ixodes* genus.

In some embodiments, the *Borrelia* polypeptide is an OspA polypeptide. In some embodiments, an antigenic ferritin polypeptide described herein is also an antigenic OspA polypeptide.

In some embodiments, an OspA polypeptide comprises a modified outer surface protein A (OspA) of *Borrelia*. OspA exists in a number of serotypes, as defined by their reactivity with monoclonal antibodies against different epitopes of OspA (see Wilske et al., J Clin Microbio 31(2):340-350 (1993)). These serotypes are correlated with different genospecies of *Borrelia* bacteria. In some embodiments, the OspA is any one of serotypes 1-7. In some embodiments, the OspA is from *Borrelia burgdorferi, Borrelia mayonii, Borrelia afzelii, Borrelia garinii*, or *Borrelia bavariensis*. In some embodiments, the OspA is *Borrelia burgdorferi* OspA. In some embodiments, the *Borrelia* can be carried by a tick of the *Ixodes* genus. In some embodiments, the *Borrelia* is *Borrelia burgdorferi, Borrelia mayonii, Borrelia afzelii, Borrelia garinii*, or *Borrelia bavariensis*.

In some embodiments, the OspA polypeptide is an OspA serotype 1 polypeptide, such as an OspA serotype 1 ectodomain. The literature has reported that an epitope of OspA serotype 1 at amino acids 165-173 of SEQ ID NO: 83 has homology with a fragment of the sequence of human leukocyte function-associated antigen-1 (hLFA-1)—i.e., SEQ ID NO: 78 (see Gross, D. M., et al., Science 281(5377): p. 703-6 (1998)). Amino acids 165-173 of SEQ ID NO: 83 are shown as an isolated nonapeptide in SEQ ID NO: 77 and are referred to as the hLFA-1 homology site. SEQ ID NO: 83 is an exemplary wild-type serotype 1 OspA sequence, which is used herein as a reference sequence for discussion of amino acid positions in OspA. This homology site may play a role in the development of Lyme arthritis, including antibiotic-resistant Lyme arthritis. In some embodiments, the OspA polypeptide comprises a modified OspA serotype 1 polypeptide of *Borrelia*, wherein the modified OspA does not comprise the sequence of SEQ ID NO: 77. Such polypeptides, when used to elicit antibodies, may have improved safety, e.g., reduced risk of triggering an autoimmune response. In some embodiments, the OspA serotype 1 polypeptide has one or more modifications that reduce identity with hLFA-1. Any modification to reduce homology to SEQ ID NO: 78, to reduce identity to SEQ ID NO: 78, or to introduce one or more non-conservative substitutions relative to SEQ ID NO: 78 is encompassed.

In some embodiments, the OspA polypeptide comprises an OspA serotype 1 polypeptide of *Borrelia*, wherein the OspA polypeptide does not comprise the sequence of SEQ ID NO: 77. In some embodiments, the OspA polypeptide comprises the ectodomain of OspA serotype 1, wherein the ectodomain does not comprise the sequence of SEQ ID NO: 77. In some embodiments, the OspA serotype 1 polypeptide comprises a sequence with at least 85%, 90%, 95%, 97%, 98%, 99%, 99.5%, or 100% identity to the sequence of any one of SEQ ID NOS: 94-102.

"Reducing homology" encompasses reducing sequence identity and/or reducing sequence similarity, wherein each member of a set of amino acids listed as conservative substitutions in Table 4 below is considered similar to the listed original residue and to the other members of the set; for example, the first line of the table indicates that alanine, valine, leucine, and isoleucine are similar to each other, and the eighth line indicates that alanine and glycine are similar to each other. Similarity is not transitive, so for example, isoleucine and glycine are not considered similar. In some embodiments, the OspA polypeptide comprises an OspA serotype 1 protein with reduced homology to hLFA-1 compared to wild-type OspA serotype 1. In some embodiments, a modified OspA comprises an OspA serotype 1 comprising a modification to any one or more of the amino acids of SEQ ID NO: 77. In some embodiments, the modification to SEQ ID NO: 77 is a non-conservative amino acid substitution. A non-conservative substitution is a substitution different from the conservative substitutions shown in the following Table.

TABLE 4

Conservative Amino Acid Substitutions

| Original Residue | Conservative Substitutions |
| --- | --- |
| Ala (A) | Val; Leu; Ile |
| Arg (R) | Lys; Gln; Asn |
| Asn (N) | Gln; His; Asp, Lys; Arg |
| Asp (D) | Glu; Asn |
| Cys (C) | Ser; Ala |
| Gln (Q) | Asn; Glu |
| Glu (E) | Asp; Gln |
| Gly (G) | Ala |
| His (H) | Asn; Gln; Lys; Arg |
| Ile (I) | Leu; Val; Met; Ala; Phe; Norleucine |
| Leu (L) | Norleucine; Ile; Val; Met; Ala; Phe |
| Lys (K) | Arg; Gln; Asn |
| Met (M) | Leu; Phe; Ile |
| Phe (F) | Trp; Leu; Val; Ile; Ala; Tyr |
| Pro (P) | Ala |
| Ser (S) | Thr |
| Thr (T) | Val; Ser |
| Trp (W) | Tyr; Phe |
| Tyr (Y) | Trp; Phe; Thr; Ser |
| Val (V) | Ile; Leu; Met; Phe; Ala; Norleucine |

In some embodiments, the OspA polypeptide comprises an OspA serotype 1 protein in which one or more of the amino acids of SEQ ID NO: 77 is replaced with the corresponding amino acid(s) of a non-serotype 1 OspA, such as serotype 2, 3, 4, 5, 6, or 7 OspA. In some embodiments, each of the amino acids of SEQ ID NO: 77 are replaced with the corresponding amino acid(s) of a serotype 2, 3, 4, 5, 6, or 7 OspA. In some embodiments, the amino acids of SEQ ID NO: 77 are replaced with corresponding amino acids of serotype 2 (S2, SEQ ID NO: 79) or serotype 3 (S3, SEQ ID NO: 80).

In some embodiments, the OspA polypeptide comprises SEQ ID NO: 81. In some embodiments, the OspA polypeptide comprises SEQ ID NO: 82. SEQ ID NOS: 81 and 82 are intended to replace SEQ ID NO: 77 and thereby reduce homology to SEQ ID NO: 78.

In some embodiments, the OspA polypeptide is a full-length OspA (e.g., including a transmembrane domain and an ectodomain, which may or may not comprise a modification to reduce homology to hLFA-1 as described herein).

In some embodiments, the OspA polypeptide lacks a transmembrane domain. In some embodiments, the polypeptide lacks a portion of a transmembrane domain, e.g., the N-terminal 2, 3, 4, 5, 6, 7, 8, 9, 10, 11, 12, 13, 14, 15, 16, 17, 18, 19, 20, 21, 22, 23, or 24 amino acids of a wild-type OspA sequence. In some embodiments, the OspA polypeptide lacks a segment including amino acid 17 of OspA serotype 1 or the corresponding position of a homolog thereof as identified by pairwise or structural alignment. In some embodiments, the OspA polypeptide lacks at least amino acids 1-17 of OspA, such as OspA serotype 1, or the counterpart amino acids in a homolog thereof as identified by pairwise or structural alignment. In some embodiments, the OspA polypeptide lacks at least the N-terminal 18, 19, 20, 21, 22, 23, or 24 amino acids of OspA, such as OspA serotype 1, or the counterpart amino acids in a homolog thereof as identified by pairwise or structural alignment. In some embodiments, the OspA polypeptide lacks amino acids 1-25 of OspA, such as OspA serotype 1, or the counterpart amino acids in a homolog thereof as identified by pairwise or structural alignment. In some embodiments, the OspA polypeptide lacks amino acids 1-26 of OspA serotype 1, or the counterpart amino acids in a homolog thereof as identified by pairwise or structural alignment. For the avoidance of doubt, lacking a transmembrane domain does not require that a polypeptide lack an N-terminal methionine; for example, a polypeptide in which the first residue is methionine and the second residue corresponds to residue 26 of a wild-type OspA, followed by residues corresponding to the 27th, 28th, etc., wild-type OspA residues, is considered to lack a transmembrane domain. In some embodiments, the polypeptide comprising an OspA polypeptide lacks a lipidation site, such as the lipidation site contained within the transmembrane domain of wild-type OspA serotype 1. In some embodiments, the OspA polypeptide lacks cysteine 17 of OspA serotype 1. In some embodiments, the OspA polypeptide does not comprise a cysteine that corresponds to any of positions 1-25 of a wild-type OspA, e.g., any of SEQ ID NOs: 83-89. In some embodiments, the polypeptide lacks or has a substitution at cysteine 17 of OspA serotype 1. In some embodiments, the OspA polypeptide lacks at least part of a wild-type OspA transmembrane domain, such that it lacks a lipidation site. In some embodiments, the OspA polypeptide lacks amino acids that align to amino acids 1-17 of OspA serotype 1.

In some embodiments, the OspA polypeptide does not comprise a palmitoyl group. In some embodiments, the OspA polypeptide does not comprise a diacylglycerol group. In some embodiments, the OspA polypeptide is non-lipidated. In some embodiments, the OspA polypeptide lacks a lipidation site. In some embodiments, this lipidation site is contained within the transmembrane domain. In some embodiments, the lipidation site that is removed is cysteine 17 of OspA serotype 1. In some embodiments, the OspA polypeptide lacks or has a substitution at cysteine 17 of OspA serotype 1.

In some embodiments, removal of an OspA lipidation site and/or transmembrane domain or portion thereof, and/or the lack of a palmitoyl and/or diacylglycoreol group, allows easier protein purification, e.g., by improving the solubility of the protein and/or making the protein more amenable to purification by techniques such as ion exchange and other forms of chromatography.

In some embodiments, the OspA polypeptide comprises a mammalian leader sequence (also known as a signal sequence). In some embodiments, the mammalian leader sequence results in secretion of the polypeptide when expressed in mammalian cells.

In some embodiments, the OspA polypeptide lacks a glycosylation site. Modifications to remove glycosylation sites are described in detail herein. The OspA polypeptides according to this disclosure can comprise any such modification, which can be combined with any of the other modifications described herein, including modifications to the hLFA-1 homology site and/or deletion of part or all of a transmembrane domain. In some embodiments, the polypeptide does not comprise SEQ ID NO: 77 (e.g., has reduced homology to hLFA-1a) and has modifications to reduce glycosylation and/or lacks a transmembrane domain.

a) Modification of Glycosylation

N-linked glycosylation is the attachment of glycan to an amide nitrogen of an asparagine (Asn; N) residue of a protein. The process of attachment results in a glycosylated protein. Glycosylation can occur at any asparagine residue in a protein that is accessible to and recognized by glycosylating enzymes following translation of the protein, and is most common at accessible asparagines that are part of an NXS/TX site, wherein the second amino acid residue following the asparagine is a serine or threonine. A non-human glycosylation pattern (e.g., resulting from expression of polypeptides comprising glycosylation sites in certain non-human cell types) can render a polypeptide undesirably reactogenic when used to elicit antibodies. Additionally, glycosylation of a polypeptide that is not normally glycosylated can alter its immunogenicity. For example, glycosylation can mask important immunogenic epitopes within a protein. Thus, to reduce or eliminate glycosylation, either asparagine residues or serine/threonine residues can be modified, for example, by substitution to another amino acid.

In some embodiments, a polypeptide comprising an OspA polypeptide is modified to reduce or eliminate glycosylation. In some embodiments, one or more N-glycosylation sites in OspA are removed. In some embodiments, the removal of an N-glycosylation site decreases glycosylation of OspA. In some embodiments, the polypeptide has decreased glycosylation relative to wild-type OspA, such as wild-type serotype 1 OspA. In some embodiments, the removal of N-glycosylation sites eliminates glycosylation of OspA.

In some embodiments, one or more asparagines in OspA are replaced with a non-asparagine amino acid. In some embodiments, each asparagine in OspA is replaced with a non-asparagine amino acid. Any natural or non-natural amino acid found in proteins, e.g., glutamine, may be used to replace asparagine. In some embodiments, the modification to reduce or eliminate glycosylation modifies an NXS/TX glycosylation site (wherein the second residue following the N is an S or T). In some embodiments, the first X in the NXS/TX site is not proline and/or the second X in the NXS/TX site is not proline. In some embodiments, the modification to reduce or eliminate glycosylation is an N to Q substitution. In some embodiments, the modification to reduce or eliminate glycosylation is an S/T to A substitution.

A detailed discussion of positions that can be modified to reduce or eliminate glycosylation below. Position numbers refer to the positions in full-length OspA sequences provided as SEQ ID NOs: 83-89. It is understood that position numbers should be adjusted appropriately for partial and modified OspA sequences (e.g., if an N-terminal deletion results in a net shortening by 25 amino acid residues, then position numbers should be decremented by 25).

In some embodiments, the modification to reduce or eliminate glycosylation comprises a substitution of any one or more of N20, N71, N190, N202, and N251 of OspA serotype 1 (SEQ ID NO: 83). In some embodiments, the modification comprises modifications at each of N71, N190, N202, and N251 of OspA serotype 1. In some embodiments, the modification to reduce or eliminate glycosylation comprises one or more of N20Q, N71Q, N190Q, N202Q, or N251Q of OspA serotype 1. Corresponding amino acids can be found in OspA of different serotypes by pair-wise alignment. Thus, in some embodiments, the asparagine residues replaced in OspA of serotypes 2-7 are amino acid residues that align with N20, N71, N190, N202, and N251 of OspA serotype 1. In some embodiments, the modification to reduce or eliminate glycosylation comprises a substitution of any one or more of a Ser or Thr residue at position 22, 73, 192, 204, and 253 of OspA serotype 1. In some embodiments, the modification comprises a substitution of one or more of a Ser or Thr residue at position 22, 73, 192, 204, and 253 of OspA serotype 1 with an alanine.

In some embodiments, the modification to reduce or eliminate glycosylation comprises substitutions any one or more of N20, N71, N141, N164, N202, and N205 of OspA serotype 2 (SEQ ID NO: 84). In some embodiments, the modification comprises modifications at each of N20, N71, N141, N164, N202, and N205 of OspA serotype 2. In some embodiments, the modification to reduce or eliminate glycosylation comprises one or more of N20Q, N71Q, N141Q, N164Q, N202Q, or N205Q of OspA serotype 2. Analogous amino acids can be found in OspA of different serotypes by pair-wise alignment. Thus, in some embodiments, the asparagine residues replaced in OspA of serotypes 1 or 3-7 are amino acid residues that align with N20, N71, N141, N164, N202, and N205 of OspA serotype 2. In some embodiments, the modification to reduce or eliminate glycosylation comprises a substitution of any one or more of a Ser or Thr residue at position 22, 73, 143, 166, 204, and 207 of OspA serotype 2. In some embodiments, the modification comprises a substitution of one or more of a Ser or Thr residue at position 22, 73, 143, 166, 204, and 207 of OspA serotype 2 with an alanine.

In some embodiments, the modification to reduce or eliminate glycosylation comprises substitutions of any one or more of N20, N71, N95, N141, N191, and N203 of OspA serotype 3 (SEQ ID NO: 85). In some embodiments, the modification comprises modifications at each of N20, N20, N71, N95, N141, N191, and N203 of OspA serotype 3. In some embodiments, the modification to reduce or eliminate glycosylation comprises one or more of N20Q, N71Q, N95Q, N141Q, N191Q, or N203Q of OspA serotype 3. Analogous amino acids can be found in OspA of different serotypes by pair-wise alignment. Thus, in some embodiments, the asparagine residues replaced in OspA of serotypes 1-2 or 4-7 are amino acid residues that align with N20, N20, N71, N95, N141, N191, and N203 of OspA serotype 3. In some embodiments, the modification to reduce or eliminate glycosylation comprises a substitution of any one or more of a Ser or Thr residue at position 22, 73, 97, 143, 193, and 205 of OspA serotype 3. In some embodiments, the modification comprises a substitution of one or more of a Ser or Thr residue at position 22, 73, 97, 143, 193, and 205 of OspA serotype 3 with an alanine.

In some embodiments, the modification to reduce or eliminate glycosylation comprises substitutions of any one or more of N20, N71, N141, N202, N205, and N219 of OspA serotype 4 (SEQ ID NO: 86). In some embodiments, the modification comprises modifications at each of N20, N71, N141, N202, N205, and N219 of OspA serotype 4. In some embodiments, the modification to reduce or eliminate glycosylation comprises one or more of N20Q, N71Q, N141Q, N202Q, N205Q, or N219Q of OspA serotype 4. Analogous amino acids can be found in OspA of different serotypes by pair-wise alignment. Thus, in some embodiments, the asparagine residues replaced in OspA of serotypes 1-3 or 5-7 are amino acid residues that align with N20, N71, N141, N202, N205, and N219 of OspA serotype 4. In some embodiments, the modification to reduce or eliminate glycosylation comprises a substitution of any one or more of a Ser or Thr residue at position 22, 73, 143, 204, 207, and 221 of OspA serotype 4. In some embodiments, the modification comprises a substitution of one or more of a Ser or Thr residue at position 22, 73, 143, 204, 207, and 221 of OspA serotype 4 with an alanine.

In some embodiments, the modification to reduce or eliminate glycosylation comprises substitutions of any one or more of N20, N71, and N141 of OspA serotype 5. (Certain serotypes, including serotypes 5-7, contain fewer glycosylation sites than certain other OspA sequences such as serotype 1). In some embodiments, the modification comprises modifications at each of N20, N71, and N141 of OspA serotype 5 (SEQ ID NO: 87). In some embodiments, the modification to reduce or eliminate glycosylation comprises one or more of N20Q, N71Q, or N141Q of OspA serotype 5. Analogous amino acids can be found in OspA of different serotypes by pair-wise alignment. Thus, in some embodiments, the asparagine residues replaced in OspA of serotypes 1-4 or 6-7 are amino acid residues that align with N20, N71, and N141 of OspA serotype 5. In some embodiments, the modification to reduce or eliminate glycosylation comprises a substitution of any one or more of a Ser or Thr residue at position 22, 73, and 143 of OspA serotype 5. In some embodiments, the modification comprises a substitution of one or more of a Ser or Thr residue at position 22, 73, and 143 of OspA serotype 5 with an alanine.

In some embodiments, the modification to reduce or eliminate glycosylation comprises substitutions of any one or more of N20, N71, and N141 of OspA serotype 6 (SEQ ID NO: 88). In some embodiments, the modification comprises modifications at each of N20, N71, and N141 of OspA serotype 6. In some embodiments, the modification to reduce or eliminate glycosylation comprises one or more of N20Q, N71Q, or N141Q of OspA serotype 6. Analogous amino acids can be found in OspA of different serotypes by pair-wise alignment. Thus, in some embodiments, the asparagine residues replaced in OspA of serotypes 1-5 or 7 are amino acid residues that align with N20, N71, and N141 of OspA serotype 6. In some embodiments, the modification to reduce or eliminate glycosylation comprises a substitution of any one or more of a Ser or Thr residue at position 22, 73, and 143 of OspA serotype 6. In some embodiments, the modification comprises a substitution of one or more of a Ser or Thr residue at position 22, 73, and 143 of OspA serotype 6 with an alanine.

In some embodiments, the modification to reduce or eliminate glycosylation comprises substitutions of any one or more of N20, N71, N141, and N191 of OspA serotype 7 (SEQ ID NO: 89). In some embodiments, the modification comprises modifications at each of N20, N71, N141, and N191 of OspA serotype 7. In some embodiments, the modification to reduce or eliminate glycosylation comprises one or more of N20Q, N71Q, N141Q, or N191Q of OspA serotype 7. Analogous amino acids can be found in OspA of different serotypes by pair-wise alignment. Thus, in some embodiments, the asparagine residues replaced in OspA of serotypes 1-6 are amino acid residues that align with N20, N71, N141, and N191 of OspA serotype 7. In some embodiments, the modification to reduce or eliminate glycosylation comprises a substitution of any one or more of a Ser or Thr residue at position 22, 73, 143, and 193 of OspA serotype 7. In some embodiments, the modification comprises a substitution of one or more of a Ser or Thr residue at position 22, 73, 143, and 193 of OspA serotype 7 with an alanine.

5. RSV Polypeptides as Non-Ferritin Polypeptides

In some embodiments, a ferritin polypeptide described herein further comprises an RSV polypeptide. In some embodiments, the non-ferritin polypeptide of an antigenic ferritin polypeptide described herein is an RSV polypeptide. In some embodiments, an antigenic ferritin polypeptide described herein is an antigenic RSV polypeptide. The RSV polypeptide can be an RSV F polypeptide, such as any of the RSV F polypeptides described herein. The RSV F polypeptide may comprise the whole sequence of RSV F or a portion of RSV F. The RSV F polypeptide may comprise one or more modification (e.g., amino acid substitution) compared to a wild-type sequence. The RSV polypeptide can be an RSV G polypeptide, such as any of the RSV G polypeptides described herein.

a) RSV F Polypeptides

In some embodiments, the RSV F polypeptide is a full length or fragment wild-type RSV F polypeptide. In some embodiments, an epitope of the RSV F polypeptide that is shared between pre-fusion RSV F and post-fusion RSV F is blocked. Blocking an epitope reduces or eliminates the generation of antibodies against the epitope when the antigenic RSV polypeptide is administered to a subject. This can increase the proportion of antibodies that target an epitope specific to a particular conformation of F, such as the pre-fusion conformation. Because F has the pre-fusion conformation in viruses that have not yet entered cells, an increased proportion of antibodies that target pre-fusion F can provide a greater degree of neutralization (e.g., expressed as a neutralizing to binding ratio, as described herein). Blocking can be achieved by engineering a bulky moiety such as an N-glycan in the vicinity of the shared epitope. For example, an N-glycosylation site not present in wild-type F can be added, e.g., by mutating an appropriate residue to asparagine. In some embodiments, the blocked epitope is an epitope of antigenic site 1 of RSV F. In some embodiments, two or more epitopes shared between pre-fusion RSV F and post-fusion RSV F are blocked. In some embodiments, two or more epitopes of antigenic site 1 of RSV F are blocked. In some embodiments, one or more, or all, epitopes that topologically overlap with the blocked epitope are also blocked, optionally wherein the blocked epitope is an epitope of antigenic site 1 of RSV F.

In some embodiments, the RSV F polypeptide comprises an asparagine corresponding to position 328, 348, or 507 of SEQ ID NO: 526. In some embodiments, the polypeptide comprises asparagines that correspond to at least two of positions 328, 348, or 507 of SEQ ID NO: 526. In some embodiments, the polypeptide comprises asparagines that correspond to positions 328, 348, or 507 of SEQ ID NO: 526. As described in the examples, it has been found that such asparagines can function as glycosylation sites. Furthermore, without wishing to be bound by any particular theory, glycans at these sites may inhibit development of antibodies to nearby epitopes, which include epitopes common to pre- and post-fusion RSV F protein, when the polypeptide is administered to a subject. In some embodiments, glycosylation of the asparagine corresponding to position 328, 348, or 507 of SEQ ID NO: 26 blocks at least one epitope shared between pre-fusion RSV F and post-fusion RSV F, such as an epitope of antigenic site 1. Inhibiting the development of antibodies to epitopes common to pre- and post-fusion RSV F protein can be beneficial because it can direct antibody development against epitopes specific to pre-fusion RSV F protein, such as the site 0 epitope, which may have more effective neutralizing activity than antibodies to other RSV F epitopes. The site 0 epitope involves amino acid residues 62-69 and 196-209 of SEQ ID NO: 526. Accordingly, in some embodiments, the RSV F polypeptide comprises amino acid residues 62-69 and 196-209 of SEQ ID NO: 526.

It should be noted that constructs described herein may have deletions or substitutions of different length relative to wild type RSV F. For example, in the construct of SEQ ID NO: 523 and others, positions 98-144 of the wild-type sequence (SEQ ID NO: 526) are replaced with GSGNVGL (positions 98-104 of SEQ ID NO: 523; also SEQ ID NO: 531), resulting in a net removal of 40 amino acids, such that positions 328, 348, or 507 of SEQ ID NO: 526 correspond to positions 288, 308, and 467 of SEQ ID NO: 523. In general, positions in constructs described herein can be mapped onto the wild-type sequence of SEQ ID NO: 526 by pairwise alignment, e.g., using the Needleman-Wunsch algorithm with standard parameters (EBLOSUM62 matrix, Gap penalty 10, gap extension penalty 0.5). See also the discussion of structural alignment provided herein as an alternative approach for identifying corresponding positions.

In some embodiments, the RSV F polypeptide comprises mutations that add glycans to block epitopes on the pre-fusion antigen that are structurally similar to those on the surface of the post-fusion RSV F. In some embodiments, glycans are added to specifically block epitopes that may be present in the post-fusion conformation of RSV F. In some embodiments, glycans are added that block epitopes that may be present in the post-fusion confirmation of RSV F but do not affect one or more epitopes present on the pre-fusion confirmation of RSV F, such as the site 0 epitope.

In some embodiments, the glycans added at the one or more glycosylation sites discussed above increase secretion in expression systems, such as mammalian cells, compared to other constructs.

In some embodiments, the RSV F polypeptide comprises a sequence having at least 85%, 90%, 95%, 97%, 98%, 99%, or 99.5% identity to amino acids 1-478 of SEQ ID NO: 517. In some embodiments, the RSV F polypeptide comprises a sequence having at least 85%, 90%, 95%, 97%, 98%, 99%, or 99.5% identity to the sequence of SEQ ID NO: 517. In some embodiments, the RSV F polypeptide comprises amino acids 1-478 of SEQ ID NO: 517. In some embodiments, the RSV F polypeptide comprises the sequence of SEQ ID NO: 517.

In some embodiments, the RSV F polypeptide comprises a sequence having at least 85%, 90%, 95%, 97%, 98%, 99%, or 99.5% identity to amino acids 1-478 of SEQ ID NO: 523. In some embodiments, the RSV F polypeptide comprises a sequence having at least 85%, 90%, 95%, 97%, 98%, 99%, or 99.5% identity to the sequence of SEQ ID NO: 523. In some embodiments, the RSV F polypeptide comprises amino acids 1-478 of SEQ ID NO: 523. In some embodiments, the RSV F polypeptide comprises the sequence of SEQ ID NO: 523.

In some embodiments, the RSV F polypeptide comprises the DS-CAV1 sequence (as described, for example, in McLellan, J. S., et al., Science 342(6158):592-598 (2013)) (SEQ ID NO: 525) in which further modifications are made including at least one, two, or three of the asparagines described above.

In some embodiments, the polypeptide further comprises a ferritin protein. The ferritin protein can further comprise any of the features described below in the section concerning ferritin, or a combination thereof.

The RSV F polypeptide can alternatively or additionally comprise any of the additional features set forth in the following discussion, or any feasible combination of such features.

Single Chain Constructs

In some embodiments, the RSV F polypeptide is a single chain construct, e.g., an RSV F polypeptide that lacks furin cleavage sites. In some embodiments, an RSV F lacks one or more furin cleavage sites. Constructs that lack furin cleavage sites are expressed as single polypeptides that are not cleaved into the biological F1/F2 fragments of the native F protein.

Amino Acid Substitutions

In some embodiments, an RSV F comprises a single amino acid substitution relative to a wild-type sequence. In some embodiments, an RSV F comprises more than one single amino acid substitution, e.g., 2, 3, 4, 5, 6, 7, 8, 9, 10, 11, 12, 13, 14, or 15 substitutions relative to a wild-type sequence. An exemplary wild-type sequence is SEQ ID NO: 526.

In some embodiments, an amino acid substitution or pair of amino acid substitutions are inter-protomer stabilizing substitution(s). Exemplary substitutions that can be inter-protomer stabilizing are V207L; N228F; I217V and E218F; I221L and E222M; or Q224A and Q225L, using the position numbering of SEQ ID NO: 526.

In some embodiments, an amino acid substitution or pair of amino acid substitutions are intra-protomer stabilizing. Exemplary substitutions that can be intra-protomer stabilizing are V220I; and A74L and Q81L, using the position numbering of SEQ ID NO: 526.

In some embodiments, an amino acid substitution is helix stabilizing, i.e., predicted to stabilize the helical domain of RSV F. Stabilization of the helical domain can contribute to the stability of the site 0 epitope and of the pre-fusion conformation of RSV F generally. Exemplary substitutions that can be helix stabilizing are N216P or I217P, using the position numbering of SEQ ID NO: 526.

In some embodiments, an amino acid substitution is helix capping. In some embodiments, an amino acid substitution is helix PRO capping. Helix capping is based on the biophysical observation that, while a proline residue mutation place in an alpha helix may disrupt the helix formation, a proline at the N-terminus of a helical region may help induce helical formation by stabilizing the PHI/PSI bond angles. Exemplary substitutions that can be helix capping are N216P or I217P, using the position numbering of SEQ ID NO: 526

In some embodiments, an amino acid substitution replaces a disulfide mutation of DS-CAV1. In some embodiments, the engineered disulfide of DS-CAV1 is reverted to wild-type (C69S and/or C212S mutations of DS-CAV1, using the position numbering of SEQ ID NO: 526. In some embodiments, one or more C residue of DS-CAV1 is replaced with a S residue to eliminate a disulfide bond. In some embodiments, C69S or C212S substitution using the position numbering of SEQ ID NO: 526 eliminates a disulfide bond. In some embodiments, an RSV F polypeptide comprises both C69S and C212S using the position numbering of SEQ ID NO: 526. In some embodiments, replacing such cysteines and thereby eliminating a disulfide bond blocks reduction (i.e. acceptance of electrons from a reducing agent) of the RSV F polypeptide. In some embodiments, an I217P substitution using the position numbering of SEQ ID NO: 526 is comprised in an antigen instead of substitution at C69 and/or C212. Position 217 in SEQ ID NO: 526 corresponds to position 177 in SEQ ID NO: 523.

In some embodiments, an amino acid substitution prevents proteolysis by trypsin or trypsin-like proteases. In some embodiments, the amino acid substitution that prevents such proteolysis is in the heptad repeat region B (HRB) region of RSV F. Appearance of fragments consistent with proteolysis of an RSV F-ferritin construct that comprised a wild-type HRB region suggested a lysine or arginine in this region was being targeted for proteolysis. An amino acid substitution to remove a K or R residue may be termed a knockout (KO). In some embodiments, a K or R is substituted for L or Q. In some embodiments, a K is substituted for L or Q. In some embodiments, the RSV F polypeptide comprises K498L and/or K508Q, using the position numbering of SEQ ID NO: 526. The corresponding positions in SEQ ID NO: 523 are 458 and 468, respectively. In some embodiments, the RSV F polypeptide comprises both K498L and K508Q.

In some embodiments, an amino acid substitution adds glycans. In some embodiments, an amino acid substitution increases glycosylation by adding glycans to RSV F polypeptides. Substitutions to add glycans may also be referred to as engineered glycosylation, as compared to native glycosylation (without additional glycans).

In some embodiments, the amino acid substitution to add glycans was substitution with an N. In some embodiments, amino acid substitution with an N allows N-linked glycosylation. In some embodiments, substitution with an N is accompanied by substitution with a T or S at the second amino acid position C-terminal to the N, which forms an NxT/S glycosylation motif. In some embodiments, the N is surface-exposed. As shown in the examples below, mutations that increased glycosylation could provide increased expression of a polypeptide comprising an RSV F polypeptide.

Changes to the Properties of the RSV F Polypeptide Based on Modifications

Modifications to the amino sequence of RSV F can change the properties of an RSV F polypeptide. A property of an RSV F polypeptide can include any structural or functional characteristic of the RSV F polypeptide.

In some embodiments, a single modification to the amino acid sequence changes multiple properties of the RSV F polypeptide. In some embodiments, an RSV F polypeptide can comprise multiple modifications that change different properties of an RSV F polypeptide. In some embodiments, multiple modifications produce a greater change in the properties of an RSV F polypeptide.

In some embodiments, multiple modifications can have an additive effect on a particular property. For example, two amino acid substitutions to add glycans can produce a greater increase in glycosylation of the RSV F polypeptide compared to either single amino acid substitution.

In some embodiments, multiple modifications affect different properties of an RSV F polypeptide. For example, one or more amino acid substitutions to increase glycosylation can be made together with one or more amino acid substitutions to block reduction.

In some embodiments, modifications to an RSV F polypeptide stabilize the pre-fusion confirmation.

In some embodiments, modifications stabilize the site 0 epitope (also known as antigenic site 0) of pre-fusion RSV F, as described, for example, in McLellan et al., Science 340(6136):1113-1117 (2013). In some embodiments, a modification that stabilizes the site 0 epitope is inter-protomer stabilizing. In some embodiments, a modification that stabilizes the site 0 epitope stabilizes pre-fusion F, as measured by Site 0 and Site V binding as measured by binding to antibodies D25 or AM14, respectively.

In some embodiments, modifications increase expression of RSV F in expression systems. In some embodiments, modifications increase secretion of RSV F in expression systems. In some embodiments, modifications increase stability of the recombinant RSV F after expression. This change can be in any type of expression system, such as bacterial, fungal, insect, or mammalian.

In some embodiments, amino acid substitutions that introduce a proline increase expression compared to other constructs. In some embodiments, amino acid substitutions that add glycans increase expression compared to other constructs. In some embodiments, amino acid substitutions that substitute K or R for other amino acids increase expression compared to other constructs. An observable increase in expression can result from any mechanism that increases the yield of a fermentation run or other production process, including relative inhibition of protease cleavage or degradation and/or increase in stability in the host cell or in the extracellular milieu. In some embodiments, amino acid substitutions that substitute one or more K residues in the HRB region of RSV F for other amino acids increase expression compared to other constructs.

In some embodiments, amino acid substitutions that substitute K for other amino acids increase stability of RSV F polypeptides. In some embodiments, amino acid substitutions that substitute one or more K residues in the HRB region of RSV F for other amino acids increase stability of RSV F polypeptides. In some embodiments, this increased stability is due to a reduction in protease cleavage.

In some embodiments, an RSV F comprises mutation(s) that remove a disulfide, e.g., to prevent conjugation after reduction. In some embodiments, the I217P substitution blocks reduction of the RSV F polypeptide. In some embodiments, amino acid substitutions that substitute K for other amino acids block reduction of the RSV F polypeptide in the presence of a reducing agent.

In some embodiments, single chain constructs increase expression compared to other constructs.

In some embodiments, the RSV F polypeptide comprises the DS-CAV1 sequence (SEQ ID NO: 525) (as described, for example, in McLellan, J. S., et al., Science 342(6158): 592-598 (2013)). In some embodiments, the RSV F polypeptide comprises the sequence of DS-CAV1 in which further modifications are made, e.g., including at least one, two, or three of the asparagines described above.

b) RSV G Polypeptides

As used herein, an RSV G polypeptide may comprise the whole sequence of RSV G or a portion of RSV G. An RSV G polypeptide may comprise modifications compared to a wild-type sequence. In some embodiments, the RSV G polypeptide is an RSV G modified as compared to wild-type RSV G (SEQ ID NO: 527). In some embodiments, these modifications are changes to the amino acid of the RSV G polypeptide as compared to wild-type RSV G.

In some embodiments, the RSV G polypeptide comprises all or part of the ectodomain of RSV G (SEQ ID NO: 528 or positions corresponding thereto). In some embodiments, the RSV G polypeptide comprises all or part of the Gcc region (amino acids 151-193 of RSV G (SEQ ID NO: 527)). In some embodiments, the RSV G polypeptide comprises a CX3C motif. In some embodiments, the RSV G polypeptide binds to the CX3CR1 receptor. The Gcc region is both conserved and immunogenic, and thus can be used to elicit antibodies with broad activity against RSV strains. In some embodiments, an RSV Gcc strain A is provided as shown in SEQ ID NO: 536. In some embodiments, an RSV Gcc strain B is provided as shown in SEQ ID NO: 537.

In some embodiments, the RSV G polypeptide is not glycosylated. For example, an RSV G polypeptide can lack NXS/TX glycosylation sites, either due to truncation or mutation of N or S/T residues (e.g., to Q or A, respectively), or a combination thereof.

In some embodiments, the RSV G polypeptide can be conjugated to a ferritin as described herein, such as via a surface-exposed cysteine on the ferritin. In some embodiments, this ferritin nanoparticle is a fusion protein also comprising an RSV F polypeptide, such as any of the polypeptides comprising an RSV F polypeptide and a ferritin protein described above.

D. Exemplary Compositions, Kits, Nucleic Acids, Uses, and Methods

In some embodiments, the present invention provides methods of immunizing a subject against infection with a pathogen. The present invention further provides methods of eliciting an immune response against a pathogen in a subject. In some embodiments, the present methods comprise administering to the subject an effective amount of a pharmaceutical composition described herein to a subject. In some embodiments, the present methods comprises administering to the subject an effective amount of an antigenic ferritin polypeptide or nanoparticle described herein to a subject.

In some embodiments, the compositions described herein are administered to a subject, including a human, to immunize them from infection with a pathogen. In some embodiments, the compositions described herein are for use in immunizing a subject, such as a human. In some embodiments, the composition administered comprises a polypeptide comprising the sequence of any one of SEQ ID NOS: 1-76, 301-343, 401-403, 410, 413-414, 417-427 or 501-523. In some embodiments, administration immunizes against influenza, EBV, RSV, or a *Borrelia*.

Likewise, the compositions may be administered to produce a protective immune response to future infection. In some embodiments, the future infection is an influenza, EBV, RSV, or *Borrelia* infection.

In some embodiments, the protective immune response decreases the incidence of hospitalization. In some embodiments, where the composition comprises an influenza polypeptide, the protective immune response decreases the incidence of laboratory-confirmed influenza infection. In some embodiments, where the composition comprises an EBV polypeptide, the protective immune response decreases the incidence of EBV infection, mononucleosis, complications caused by mononucleosis (e.g. hepatitis, encephalitis, severe hemolytic anemia, or splenomegaly), nasopharyngeal cancer, gastric cancer, or B lymphoma (including Burkitt's or Hodgkin's lymphoma). In some embodiments, where the composition comprises an RSV polypeptide, the protective immune response decreases the incidence of infection with RSV, pneumonia, bronchiolitis, or asthma. In some embodiments, where the composition comprises a *Borrelia* polypeptide, the protective immune response decreases the incidence of acute or chronic Lyme disease, including joint inflammation, neurological symptoms, cognitive deficits, or heart rhythm irregularities.

1. Subjects

In some embodiments, the subject is a mammal. In some embodiments, the subject is a human.

In some embodiments, the subject is an adult (greater than or equal to 18 years of age). In some embodiments, the subject is a child or adolescent (less than 18 years of age). In some embodiments, the subject is elderly (greater than 60 years of age). In some embodiments, the subject is a non-elderly adult (greater than or equal to 18 years of age and less than or equal to 60 years of age).

In some embodiments, more than one administration of the composition is administered to the subject. In some embodiments, a booster administration improves the immune response.

In some embodiments, any one or more of the antigenic polypeptides, or compositions described herein are for use in a mammal, such as a primate (e.g., non-human primate, such as a monkey (e.g., a macaque, such as rhesus or cynomolgus) or ape), rodent (e.g., mouse or rat), or domesticated mammal (e.g., dog, rabbit, cat, horse, sheep, cow, goat, camel, or donkey). In some embodiments, any one or more of the antigenic polypeptides, or compositions described herein are for use in a bird, such as a fowl (e.g., chicken, turkey, duck, goose, guineafowl, or swan).

2. Adjuvants

As described herein, adjuvants may be conjugated to ferritin via a surface exposed amino acid, e.g., a cysteine. Non-conjugated adjuvant may also be administered together with the antigenic ferritin polypeptides described herein to a subject. In some embodiments, administration of adjuvant together with the antigenic ferritin polypeptide produces a higher titer of antibodies against the non-ferritin polypeptide in the subject as compared to administration of the non-ferritin polypeptide alone, or antigenic ferritin polypeptide alone, without the adjuvant. An adjuvant may promote earlier, more potent, or more persistent immune response to the antigenic polypeptide.

In some embodiments, a composition comprises one adjuvant. In some embodiments, a composition comprises more than one adjuvant. In some embodiments, a composition does not comprise an adjuvant.

In some embodiments, an adjuvant comprises aluminum. In some embodiments, an adjuvant is aluminum phosphate. In some embodiments, an adjuvant is Alum (Alyhydrogel '85 2%; Brenntag—Cat #21645-51-2).

In some embodiments, an adjuvant is an organic adjuvant. In some embodiments, an adjuvant is an oil-based adjuvant. In some embodiments, an adjuvant comprises an oil-in-water nanoemulsion.

In some embodiments, an adjuvant comprises squalene. In some embodiments, the adjuvant comprising squalene is Ribi (Sigma adjuvant system Cat #S6322-1vl), Addavax™ MF59, AS03, or AF03 (see U.S. Pat. No. 9,703,095). In some embodiments, the adjuvant comprising squalene is a nanoemulsion.

In some embodiments, an adjuvant comprises a polyacrylic acid polymer (PAA). In some embodiments, the adjuvant comprising PAA is SPA09 (see WO 2017218819).

In some embodiments, an adjuvant comprises non-metabolizable oils. In some embodiments, the adjuvant is Incomplete Freund's Adjuvant (IFA).

In some embodiments, an adjuvant comprises non-metabolizable oils and killed *Mycobacterium tuberculosis*. In some embodiments, the adjuvant is Complete Freund's Adjuvant (CFA).

In some embodiments, an adjuvant is a lipopolysaccharide. In some embodiments, an adjuvant is monophosphoryl A (MPL or MPLA).

3. Pharmaceutical Compositions

In various embodiments, a pharmaceutical composition comprising an antigenic ferritin polypeptide described herein and/or related entities is provided. In some embodiments, the pharmaceutical composition is an immunogenic composition (e.g., a vaccine) capable of eliciting an immune response such as a protective immune response against a pathogen.

For example, in some embodiments, the pharmaceutical compositions may comprise one or more of the following: (1) an antigenic ferritin protein comprising (i) a mutation replacing a surface-exposed amino acid with a cysteine and (ii) a non-ferritin polypeptide; (2) an antigenic ferritin protein comprising (i) a mutation replacing a surface exposed amino acid with a cysteine and an immune-stimulatory moiety linked to the cysteine; and (ii) a non-ferritin polypeptide; (3) antigenic ferritin protein comprising (i) a surface-exposed cysteine, (ii) a peptide linker N-terminal to the ferritin protein, and (iii) a non-ferritin polypeptide N-terminal to the peptide linker; (4) an antigenic ferritin protein comprising: (i) a mutation replacing a surface exposed amino acid with a cysteine and an immune-stimulatory moiety linked to the cysteine, (ii) a mutation replacing the internal cysteine at position 31 of *H. pylori* ferritin, or a mutation of an internal cysteine at a position that is analogous to position 31 of a non-*H. pylori* ferritin as determined by pair-wise or structural alignment, with a non-cysteine amino acid, (iii) a mutation replacing a surface-exposed asparagine with a non-asparagine amino acid, and (iv) a non-ferritin polypeptide; or (5) a ferritin particle comprising any of the foregoing ferritin proteins.

In some embodiments, the present invention provides pharmaceutical compositions comprising antibodies or other agents related to the antigenic polypeptides described herein. In an embodiment, the pharmaceutical composition comprises antibodies that bind to and/or compete with an antigenic polypeptide described herein. Alternatively, the antibodies may recognize viral particles or bacteria comprising the non-ferritin polypeptide component of an antigenic polypeptide described herein.

In some embodiments, the pharmaceutical compositions as described herein are administered alone or in combination with one or more agents to enhance an immune response, e.g., an adjuvant described above. In some embodiments, a pharmaceutical composition further comprises an adjuvant described above.

In some embodiments, the pharmaceutical composition further comprises a pharmaceutically acceptable carrier or excipient. As used herein, the term "carrier" refers to a diluent, adjuvant, excipient, or vehicle with which a pharmaceutical composition is administered. In exemplary embodiments, carriers can include sterile liquids, such as, for example, water and oils, including oils of petroleum, animal, vegetable, or synthetic origin, such as, for example, peanut oil, soybean oil, mineral oil, sesame oil and the like. In some embodiments, carriers are or include one or more solid components. Pharmaceutically acceptable carriers can also include, but are not limited to, saline, buffered saline, dextrose, glycerol, ethanol, and combinations thereof. As used herein, an excipient is any non-therapeutic agent that may be included in a pharmaceutical composition, for example to provide or contribute to a desired consistency or stabilizing effect. Suitable pharmaceutical excipients include, but are not limited to, starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. In various embodiments, the pharmaceutical composition is sterile.

In some embodiments, the pharmaceutical composition contains minor amounts of wetting or emulsifying agents, or pH buffering agents. In some embodiments, the pharmaceutical compositions of may include any of a variety of additives, such as stabilizers, buffers, or preservatives. In addition, auxiliary, stabilizing, thickening, lubricating, and coloring agents can be included.

In various embodiments, the pharmaceutical composition may be formulated to suit any desired mode of administration. For example, the pharmaceutical composition can take the form of solutions, suspensions, emulsion, drops, tablets, pills, pellets, capsules, capsules containing liquids, gelatin capsules, powders, sustained-release formulations, suppositories, emulsions, aerosols, sprays, suspensions, lyophilized powder, frozen suspension, desiccated powder, or any other form suitable for use. General considerations in the formulation and manufacture of pharmaceutical agents may be found, for example, in Remington's Pharmaceutical Sciences, 19$^{th}$ ed., Mack Publishing Co., Easton, PA, 1995; incorporated herein by reference.

The pharmaceutical composition can be administered via any route of administration. Routes of administration include, for example, oral, intradermal, intramuscular, intraperitoneal, intravenous, subcutaneous, intranasal, mucosal, epidural, sublingual, intranasal, intracerebral, intravaginal, transdermal, rectally, by intratracheal instillation, bronchial instillation, inhalation, or topically. Administration can be local or systemic. In some embodiments, administration is carried out orally. In another embodiment, the administration is by parenteral injection. In some instances, administration results in the release of the antigenic ferritin polypeptide described herein into the bloodstream. The mode of administration can be left to the discretion of the practitioner.

In some embodiments, the pharmaceutical composition is suitable for parenteral administration (e.g. intravenous, intramuscular, intraperitoneal, and subcutaneous). Such compositions can be formulated as, for example, solutions, suspensions, dispersions, emulsions, and the like. They may also be manufactured in the form of sterile solid compositions (e.g. lyophilized composition), which can be dissolved or suspended in sterile injectable medium immediately before use. For example, parenteral administration can be achieved by injection. In such embodiments, injectables are prepared in conventional forms, i.e., either as liquid solutions or suspensions, solid forms suitable for solution or suspension in liquid prior to injection, or as emulsions. In some embodiments, injection solutions and suspensions are prepared from sterile powders, lyophilized powders, or granules.

In a further embodiment, the pharmaceutical composition is formulated for delivery by inhalation (e.g., for direct delivery to the lungs and the respiratory system). For example, the composition may take the form of a nasal spray or any other known aerosol formulation. In some embodiments, preparations for inhaled or aerosol delivery comprise a plurality of particles. In some embodiments, such preparations can have a mean particle size of about 1, about 2, about 3, about 4, about 5, about 6, about 7, about 8, about 9, about 10, about 11, about 12, or about 13 microns. In some embodiments, preparations for inhaled or aerosol delivery are formulated as a dry powder. In some embodiments, preparations for inhaled or aerosol delivery are formulated as a wet powder, for example through inclusion of a wetting agent. In some embodiments, the wetting agent is selected from the group consisting of water, saline, or other liquid of physiological pH.

In some embodiments, the pharmaceutical composition in accordance with the invention are administered as drops to the nasal or buccal cavity. In some embodiments, a dose may comprise a plurality of drops (e.g., 1-100, 1-50, 1-20, 1-10, 1-5, etc.).

The present pharmaceutical composition may be administered in any dose appropriate to achieve a desired outcome. In some embodiments, the desired outcome is the induction of a long-lasting adaptive immune response against a pathogen, such as the source of a non-ferritin polypeptide present in an antigenic ferritin polypeptide present in the composition. In some embodiments, the desired outcome is a reduction in the intensity, severity, frequency, and/or delay of onset of one or more symptoms of infection. In some embodiments, the desired outcome is the inhibition or prevention of infection. The dose required will vary from subject to subject depending on the species, age, weight, and general condition of the subject, the severity of the infection being prevented or treated, the particular composition being used, and its mode of administration.

In some embodiments, pharmaceutical compositions in accordance with the invention are administered in single or multiple doses. In some embodiments, the pharmaceutical compositions are administered in multiple doses administered on different days (e.g., prime-boost vaccination strategies). In some embodiments, the pharmaceutical composition is administered as part of a booster regimen.

In various embodiments, the pharmaceutical composition is co-administered with one or more additional therapeutic agents. Co-administration does not require the therapeutic agents to be administered simultaneously, if the timing of their administration is such that the pharmacological activities of the additional therapeutic agent and the active ingredient(s) in the pharmaceutical composition overlap in time, thereby exerting a combined therapeutic effect. In general, each agent will be administered at a dose and on a time schedule determined for that agent.

4. Nucleic Acid/mRNA

Also provided is a nucleic acid encoding an antigenic polypeptide described herein. In some embodiments, the nucleic acid is an mRNA. Any nucleic acid capable of undergoing translation resulting in a polypeptide is considered an mRNA for purposes of this disclosure.

5. Kits

Also provided herein are kits comprising one or more antigenic polypeptides, nucleic acids, antigenic ferritin particles, antigenic lumazine synthase particles, compositions, or pharmaceutical compositions described herein. In some embodiments, a kit further comprises one or more of a solvent, solution, buffer, instructions, or desiccant.

This description and exemplary embodiments should not be taken as limiting. For the purposes of this specification and appended claims, unless otherwise indicated, all numbers expressing quantities, percentages, or proportions, and other numerical values used in the specification and claims, are to be understood as being modified in all instances by the term "about," to the extent they are not already so modified. "About" indicates a degree of variation that does not substantially affect the properties of the described subject matter, e.g., within 10%, 5%, 2%, or 1%. Accordingly, unless indicated to the contrary, the numerical parameters set forth in the following specification and attached claims are approximations that may vary depending upon the desired properties sought to be obtained. At the very least, and not as an attempt to limit the application of the doctrine of equivalents to the scope of the claims, each numerical parameter should at least be construed considering the number of reported significant digits and by applying ordinary rounding techniques.

It is noted that, as used in this specification and the appended claims, the singular forms "a," "an," and "the," and any singular use of any word, include plural referents unless expressly and unequivocally limited to one referent. As used herein, the term "include" and its grammatical variants are intended to be non-limiting, such that recitation of items in a list is not to the exclusion of other like items that can be substituted or added to the listed items. The word "or" is used in an inclusive sense, i.e., equivalent to "and/or," unless the context dictates otherwise.

TABLE 1

(Sequence Table): Description of the Sequences

| Description | Sequences | SEQ ID NO |
|---|---|---|
| ("ferritin" refers to *H. pylori* ferritin optionally with one or more mutations unless otherwise indicated) | Key for sequences 1-102<br>Leader sequences are sometimes underlined<br>Modified LFA-1 site is Italicized and underlined (if present)<br>Mutations other than modified LFA-1 site are in BOLD and curvy underlined<br>Linker is double underlined<br>*Bullfrog sequence is Italicized and curvy underlined* (if present)<br>Human heavy chain ferritin sequence is in BOLD (if present)<br>Transmembrane domain is italicized (if present)<br>*lipidation site is in Bold, italicized, and underlined (if present)* | |
| Serotype 1<br>RD2 OspA-ferritin | MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS | 1 |
| Serotype 1<br>RD1 OspA-ferritin | MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYDLKGELSSEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS | 2 |
| Serotype 1<br>OspA-ferritin;<br>LFA-1 replacement<br>Serotype 2 | MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFTLEGKVANEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS | 3 |
| Serotype 1<br>OspA-ferritin;<br>LFA-1 replacement<br>Serotype 3 | MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFALEGTLTDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSESQVRQQFSKDIEKLLNEQVNKEMQGSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS | 4 |
| Serotype 2 | MDEKNSASVDLPGEMKVLVSKEKDKDGKYSLKATVDKIELKGTSDKDNGSGVLEGTKDDKSKAKLTIADDLSKTTFELFKEDGKTLVSRKV | 5 |

TABLE 1-continued (Sequence Table): Description of the Sequences

| Description | Sequences | SEQ ID NO |
|---|---|---|
| OspA-ferritin | SSKDKTSTDEMFNEKGELSAKTMTRENGTKLEYTEMKSDGTGKAKEVLKNFTLEGKVANDKVTLEVKEGTVTLSKEIAKSGEVTVALNDTN<br>TTQATKKTGAWDSKTSTLTISVNSKKTTQLVFTKQDTITVQKYDSAGTNLEGTAVEIKTLDELKNALKGSESQVRQQFSKDIEKLLNEQVN<br>KEMQGSNLYMSMSSWSYTHSLDGAGLFLFDHAAEEYEHAKKLIIFLNENNVPVQLTSISAPEHKFEGLTQIFQKAYEHEQHISESINNIVD<br>HAIKCKDHATFNFLQWYVAEQHEEEVLFKDILDKIELIGNENHGLYLADQYVKGIAKSRKS | |
| Serotype 3<br>OspA-ferritin | MDEKNSVSVDLPGGMKVLVSKEKDKDGKYSLMATVEKLELKGTSDKSNGSGVLEGEKADKSKAKLTISQDLNQTTFEIFKEDGKTLVSRKV<br>NSKDKSSTEEKFNDKGKLSEKVVTRANGTRLEYTEIKNDGSGKAKEVLKGFALEGTLTDGGETKLTVTEGTVTLSKNISKSGEITVALNDT<br>ETTPADKKTGEWKSDTSTLTISKNSQKPKQLVFTKENTITVQNYNRAGNALEGSPAEIKDLAELKAALKGSESQVRQQFSKDIEKLLNEQV<br>NKEMQGSNLYMSMSSWSYTHSLDGAGLFLFDHAAEEYEHAKKLIIFLNENNVPVQLTSISAPEHKFEGLTQIFQKAYEHEQHISESINNIV<br>DHAIKCKDHATFNFLQWYVAEQHEEEVLFKDILDKIELIGNENHGLYLADQYVKGIAKSRKS | 6 |
| Serotype 4<br>OspA-ferritin | MDEKNSVSVDLPGEMKVLVSKEKDKDGKYSLMATVDKLELKGTSDKSNGSGTLEGEKSDKSKAKLTISEDLSKTTFEIFKEDGKTLVSKKV<br>NSKDKSSIEEKFNAKGELSEKTILRANGTRLEYTEIKSDGTGKAKEVLKDFALEGTLAADKTTLKVTEGTVVLSKHIPNSGEITVELNDSN<br>STQATKKTGKWDSNTSTLTISVNSKKTKNIVFTKEDTITVQKYDSAGTNLEGNAVEIKTLDELKNALKGSESQVRQQFSKDIEKLLNEQVN<br>KEMQGSNLYMSMSSWSYTHSLDGAGLFLFDHAAEEYEHAKKLIIFLNENNVPVQLTSISAPEHKFEGLTQIFQKAYEHEQHISESINNIVD<br>HAIKCKDHATFNFLQWYVAEQHEEEVLFKDILDKIELIGNENHGLYLADQYVKGIAKSRKS | 7 |
| Serotype 5<br>OspA-ferritin | MDEKNSVSVDLPGGMKVLVSKEKDKDGKYSLMATVEKLELKGTSDKNNGSGTLEGEKTDKSKVKLTIAEDLSKTTFEIFKEDGKTLVSKKV<br>TLKDKSSTEEKFNEKGEISEKTIVRANGTRLEYTDIKSDGSGKAKEVLKDFTLEGTLAADGKTTLKVTEGTVVLSKNILKSGEITVALDDS<br>DTTQATKKTGKWDSKTSTLTISVNSQKTKNLVFTKEDTITVQKYDSAGTNLEGKAVEITTLEKLKDALKGSESQVRQQFSKDIEKLLNEQV<br>NKEMQGSNLYMSMSSWSYTHSLDGAGLFLFDHAAEEYEHAKKLIIFLNENNVPVQLTSISAPEHKFEGLTQIFQKAYEHEQHISESINNIV<br>DHAIKCKDHATFNFLQWYVAEQHEEEVLFKDILDKIELIGNENHGLYLADQYVKGIAKSRKS | 8 |
| Serotype 6<br>OspA-ferritin | MDEKNSVSVDLPGGMTVLVSKEKDKDGKYSLEATVDKLELKGTSDKNNGSGTLEGEKTDKSKVKSTIADDLSQTKFEIFKEDGKTLVSKKV<br>TLKDKSSTEEKFNGKGETSEKTIVRANGTRLEYTDIKSDGSGKAKEVLKDFTLEGTLAADGKTTLKVTEGTVVLSKNILKSGEITAALDDS<br>DTTRATKKTGKWDSKTSTLTISVNSQKTKNLVFTKEDTITVQRYDSAGTNLEGKAVEITTLKELKNALKGSESQVRQQFSKDIEKLLNEQV<br>NKEMQSSNLYMSMSSWSYTHSLDGAGLFLFDHAAEEYEHAKKLIIFLNENNVPVQLTSISAPEHKFEGLTQIFQKAYEHEQHISESINNIV<br>DHAIKCKDHATFNFLQWYVAEQHEEEVLFKDILDKIELIGNENHGLYLADQYVKGIAKSRKS | 9 |
| Serotype 7<br>OspA-ferritin | MDEKNSVSVDLPGEMKVLVSKEKDKDGKYSLEATVDKLELKGTSDKNNGSGVLEGVKAAKSKAKLTIADDLSQTKFEIFKEDGKTLVSKKV<br>TLKDKSSTEEKFNDKGKLSEKVVTRANGTRLEYTEIQNDGSGKAKEVLKSLTLEGTLTADGETKLTVEAGTVTLSKNISESGEITVELKDT<br>ETTPADKKSGTWDSKTSTLTISKNSQKTKQLVFTKENTITVQKYNTAGTKLEGSPAEIKDLEALKAALKGSESQVRQQFSKDIEKLLNEQV<br>NKEMQSSNLYMSMSSWSYTHSLDGAGLFLFDHAAEEYEHAKKLIIFLNENNVPVQLTSISAPEHKFEGLTQIFQKAYEHEQHISESINNIV<br>DHAIKCKDHATFNFLQWYVAEQHEEEVLFKDILDKIELIGNENHGLYLADQYVKGIAKSRKS | 10 |

TABLE 1-continued (Sequence Table): Description of the Sequences

| Description | Sequences | SEQ ID NO |
|---|---|---|
| Serotype 4<br>OspA-Cysteine-Thrombin-His | MDEKNSVSVDLPGEMKVLVSKEKDKDGKYSLMATVDKLELKGTSDKSNGSGTLEGEKSDKSKAKLTISEDLSKTTFEIFKEDGKTLVSKKV<br>NSKDKSSIEEKFNAKGELSEKTILRANGTRLEYTEIKSDGTGKAKEVLKDFALEGTLAADKTTLKVTEGTVVLSKHIPNSGEITVELNDSN<br>STQATKKTGKWDSNTSTLTISVNSKKTKNIVFTKEDTITVQKYDSAGTNLEGNAVEIKTLDELKNALKCLVPRGSLEHHHHHH | 11 |
| Serotype 1<br>OspA-lumazine<br>synthase;<br>LFA-1 replacement<br>RD2 | MDEKNSVSVDLPGEMKVLVSKEKNKDGKYDLIATVDKLELKGTSDKNNGSGVLEGVKADKSKVKLTISDDLGQTTLEVFKEDGKTLVSKKV<br>TSKDKSSTEEKFNEKGEVSEKIITRADGTRLEYTGIKSDGSGKAKEVLKG*YTLEGQLSD*EKTTLVVKEGTVTLSKNISKSGEVSVELNDTD<br>SSAATKKTAAWNSGTSTLTITVNSKKTKDLVFTKENTITVQQYDSNGTKLEGSAVEITKLDEIKNALKGGGSMQIYEGKLTAEGLRFGIVA<br>SRFNHALVDRLVEGAIDCIVRHGGREEDITLVRVPGSWEIPVAAGELARKEDIDAVIAIGVLIRGATPHFDYIASEVSKGLANLSLELRKP<br>ITFGVITADTLEQAIERAGTKHGNKGWEAALSAIEMANLFKSLR | 12 |
| Serotype 1<br>OspA-lumazine synthase;<br>LFA-1 replacement<br>RD1 | MDEKNSVSVDLPGEMKVLVSKEKNKDGKYDLIATVDKLELKGTSDKNNGSGVLEGVKADKSKVKLTISDDLGQTTLEVFKEDGKTLVSKKV<br>TSKDKSSTEEKFNEKGEVSEKIITRADGTRLEYTGIKSDGSGKAKEVLKG*YDLKGELSS*EKTTLVVKEGTVTLSKNISKSGEVSVELNDTD<br>SSAATKKTAAWNSGTSTLTITVNSKKTKDLVFTKENTITVQQYDSNGTKLEGSAVEITKLDEIKNALKGGGSMQIYEGKLTAEGLRFGIVA<br>SRFNHALVDRLVEGAIDCIVRHGGREEDITLVRVPGSWEIPVAAGELARKEDIDAVIAIGVLIRGATPHFDYIASEVSKGLANLSLELRKP<br>ITFGVITADTLEQAIERAGTKHGNKGWEAALSAIEMANLFKSLR | 13 |
| Serotype 1<br>OspA-lumazine synthase;<br>LFA-1 replacement<br>Sero2 | MDEKNSVSVDLPGEMKVLVSKEKNKDGKYDLIATVDKLELKGTSDKNNGSGVLEGVKADKSKVKLTISDDLGQTTLEVFKEDGKTLVSKKV<br>TSKDKSSTEEKFNEKGEVSEKIITRADGTRLEYTGIKSDGSGKAKEVLKG*FTLEGKVAN*EKTTLVVKEGTVTLSKNISKSGEVSVELNDTD<br>SSAATKKTAAWNSGTSTLTITVNSKKTKDLVFTKENTITVQQYDSNGTKLEGSAVEITKLDEIKNALKGGGSMQIYEGKLTAEGLRFGIVA<br>SRFNHALVDRLVEGAIDCIVRHGGREEDITLVRVPGSWEIPVAAGELARKEDIDAVIAIGVLIRGATPHFDYIASEVSKGLANLSLELRKP<br>ITFGVITADTLEQAIERAGTKHGNKGWEAALSAIEMANLFKSLR | 14 |
| Serotype 1<br>OspA-lumazine synthase;<br>LFA-1 replacement<br>Sero3 | MDEKNSVSVDLPGEMKVLVSKEKNKDGKYDLIATVDKLELKGTSDKNNGSGVLEGVKADKSKVKLTISDDLGQTTLEVFKEDGKTLVSKKV<br>TSKDKSSTEEKENEKGEVSEKIITRADGTRLEYTGIKSDGSGKAKEVLKG*FALEGTLTD*EKTTLVVKEGTVTLSKNISKSGEVSVELNDTD<br>SSAATKKTAAWNSGTSTLTITVNSKKTKDLVFTKENTITVQQYDSNGTKLEGSAVEITKLDEIKNALKGGGSMQIYEGKLTAEGLRFGIVA<br>SRFNHALVDRLVEGAIDCIVRHGGREEDITLVRVPGSWEIPVAAGELARKEDIDAVIAIGVLIRGATPHFDYIASEVSKGLANLSLELRKP<br>ITFGVITADTLEQAIERAGTKHGNKGWEAALSAIEMANLFKSLR | 15 |
| Serotype 2<br>OspA-lumazine synthase | MDEKNSASVDLPGEMKVLVSKEKDKDGKYSLKATVDKIELKGTSDKDNGSGVLEGTKDDKSKAKLTIADDLSKTTFELFKEDGKTLVSRKV<br>SSKDKTSTDEMFNEKGELSAKTMTRENGTKLEYTEMKSDGTGKAKEVLKNFTLEGKVANDKVTLEVKEGTVTLSKEIAKSGEVTVALNDTN<br>TTQATKKTGAWDSKTSTLTISVNSKKTTQLVFTKQDTITVQKYDSAGTNLEGTAVEIKTLDELKNALKGGGSMQIYEGKLTAEGLRFGIVA<br>SRFNHALVDRLVEGAIDCIVRHGGREEDITLVRVPGSWEIPVAAGELARKEDIDAVIAIGVLIRGATPHFDYIASEVSKGLANLSLELRKP<br>ITFGVITADTLEQAIERAGTKHGNKGWEAALSAIEMANLFKSLR | 16 |
| Serotype 3<br>OspA-lumazine synthase | MDEKNSVSVDLPGGMKVLVSKEKDKDGKYSLMATVEKLELKGTSDKSNGSGVLEGEKADKSKAKLTISQDLNQTTFEIFKEDGKTLVSRKV<br>NSKDKSSTEEKENDKGKLSEKVVTRANGTRLEYTEIKNDGSGKAKEVLKGFALEGTLTDGGETKLTVTEGTVTLSKNISKSGEITVALNDT<br>ETTPADKKTGEWKSDTSTLTISKNSQKPKQLVFTKENTITVQNYNRAGNALEGSPAEIKDLAELKAALKGGGSMQIYEGKLTAEGLRFGIV<br>ASRFNHALVDRLVEGAIDCIVRHGGREEDITLVRVPGSWEIPVAAGELARKEDIDAVIAIGVLIRGATPHFDYIASEVSKGLANLSLELRK<br>PITFGVITADTLEQAIERAGTKHGNKGWEAALSAIEMANLFKSLR | 17 |
| Serotype 4<br>OspA-lumazine synthase | MDEKNSVSVDLPGEMKVLVSKEKDKDGKYSLMATVDKLELKGTSDKSNGSGTLEGEKSDKSKAKLTISEDLSKTTFEIFKEDGKTLVSKKV<br>NSKDKSSIEEKFNAKGELSEKTILRANGTRLEYTEIKSDGTGKAKEVLKDFALEGTLAADKTTLKVTEGTVVLSKHIPNSGEITVELNDSN<br>STQATKKTGKWDSNTSTLTISVNSKKTKNIVFTKEDTITVQKYDSAGTNLEGNAVEIKTLDELKNALKGGGSMQIYEGKLTAEGLRFGIVA<br>SRFNHALVDRLVEGAIDCIVRHGGREEDITLVRVPGSWEIPVAAGELARKEDIDAVIAIGVLIRGATPHFDYIASEVSKGLANLSLELRKP<br>ITFGVITADTLEQAIERAGTKHGNKGWEAALSAIEMANLFKSLR | 18 |
| Serotype 5<br>OspA-lumazine synthase | MDEKNSVSVDLPGGMKVLVSKEKDKDGKYSLMATVEKLELKGTSDKNNGSGTLEGEKTDKSKVKLTIAEDLSKTTFEIFKEDGKTLVSKKV<br>TLKDKSSTEEKFNEKGEISEKTIVRANGTRLEYTDIKSDGSGKAKEVLKDFTLEGTLAADGKTTLKVTEGTVVLSKNILKSGEITVALDDS | 19 |

TABLE 1-continued (Sequence Table): Description of the Sequences

| Description | Sequences | SEQ ID NO |
|---|---|---|
| | DTTQATKKTGKWDSKTSTLTISVNSQKTKNLVFTKEDTITVQKYDSAGTNLEGKAVEITTLEKLKDALKGGGSMQIYEGKLTAEGLRFGIV<br>ASRFNHALVDRLVEGAIDCIVRHGGREEDITLVRVPGSWEIPVAAGELARKEDIDAVIAIGVLIRGATPHFDYIASEVSKGLANLSLELRK<br>PITFGVITADTLEQAIERAGTKHGNKGWEAALSAIEMANLFKSLR | |
| Serotype 6<br>OspA-lumazine synthase | MDEKNSVSVDLPGGMTVLVSKEKDKDGKYSLEATVDKLELKGTSDKNNGSGTLEGEKTDKSKVKSTIADDLSQTKFEIFKEDGKTLVSKKV<br>TLKDKSSTEEKENGKGETSEKTIVRANGTRLEYTDIKSDGSGKAKEVLKDFTLEGTLAADGKTTLKVTEGTVVLSKNILKSGEITAALDDS<br>DTTRATKKTGKWDSKTSTLTISVNSQKTKNLVFTKEDTITVQRYDSAGTNLEGKAVEITTLKELKNALKGGGSMQIYEGKLTAEGLRFGIV<br>ASRFNHALVDRLVEGAIDCIVRHGGREEDITLVRVPGSWEIPVAAGELARKEDIDAVIAIGVLIRGATPHFDYIASEVSKGLANLSLELRK<br>PITFGVITADTLEQAIERAGTKHGNKGWEAALSAIEMANLFKSLR | 20 |
| Serotype 7<br>OspA-lumazine synthase | MDEKNSVSVDLPGEMKVLVSKEKDKDGKYSLEATVDKLELKGTSDKNNGSGVLEGVKAAKSKAKLTIADDLSQTKFEIFKEDGKTLVSKKV<br>TLKDKSSTEEKENDKGKLSEKVVTRANGTRLEYTEIQNDGSGKAKEVLKSLTLEGTLTADGETKLTVEAGTVTLSKNISESGEITVELKDT<br>ETTPADKKSGTWDSKTSTLTISKNSQKTKQLVFTKENTITVQKYNTAGTKLEGSPAEIKDLEALKAALKGGGSMQIYEGKLTAEGLRFGIV<br>ASRFNHALVDRLVEGAIDCIVRHGGREEDITLVRVPGSWEIPVAAGELARKEDIDAVIAIGVLIRGATPHFDYIASEVSKGLANLSLELRK<br>PITFGVITADTLEQAIERAGTKHGNKGWEAALSAIEMANLFKSLR | 21 |
| Serotype 1<br>OspA; LFA-1 replacement<br>RD2-Human<br>Heavy chain ferritin | MDEKNSVSVDLPGEMKVLVSKEKNKDGKYDLIATVDKLELKGTSDKNNGSGVLEGVKADKSKVKLTISDDLGQTTLEVFKEDGKTLVSKKV<br>TSKDKSSTEEKENEKGEVSEKIITRADGTRLEYTGIKSDGSGKAKEVLKG*YTLEGQLSD*EKTTLVVKEGTVTLSKNISKSGEVSVELNDTD<br>SSAATKKTAAWNSGTSTLTITVNSKKTKDLVFTKENTITVQQYDSNGTKLEGSAVEITKLDEIKNALKGSMTTASTSQVRQNYHQDSEAAI<br>NRQINLELYASYVYLSMSYYFDRDDVALKNFAKYFLHQSHEEREHAEKLMKLQNQRGGRIFLQDIKKPDCDDWESGLNAMECALHLEKNVN<br>QSLLELHKLATDKNDPHLCDFIETHYLNEQVKAIKELGDHVTNLRKMGAPESGLAEYLFDKHTLGDSDNES | 22 |
| OspA Serotype1;<br>LFA-1 replacement<br>RD1-Human<br>Heavy chain ferritin | MDEKNSVSVDLPGEMKVLVSKEKNKDGKYDLIATVDKLELKGTSDKNNGSGVLEGVKADKSKVKLTISDDLGQTTLEVFKEDGKTLVSKKV<br>TSKDKSSTEEKENEKGEVSEKIITRADGTRLEYTGIKSDGSGKAKEVLKG*YDLKGELSS*EKTTLVVKEGTVTLSKNISKSGEVSVELNDTD<br>SSAATKKTAAWNSGTSTLTITVNSKKTKDLVFTKENTITVQQYDSNGTKLEGSAVEITKLDEIKNALKGSMTTASTSQVRQNYHQDSEAAI<br>NRQINLELYASYVYLSMSYYFDRDDVALKNFAKYFLHQSHEEREHAEKLMKLQNQRGGRIFLQDIKKPDCDDWESGLNAMECALHLEKNVN<br>QSLLELHKLATDKNDPHLCDFIETHYLNEQVKAIKELGDHVTNLRKMGAPESGLAEYLFDKHTLGDSDNES | 23 |
| OspA Serotype1;<br>LFA-1 replacement<br>Serotype 2-<br>Human Heavy<br>chain ferritin | MDEKNSVSVDLPGEMKVLVSKEKNKDGKYDLIATVDKLELKGTSDKNNGSGVLEGVKADKSKVKLTISDDLGQTTLEVFKEDGKTLVSKKV<br>TSKDKSSTEEKENEKGEVSEKIITRADGTRLEYTGIKSDGSGKAKEVLKG*FTLEGKVAN*EKTTLVVKEGTVTLSKNISKSGEVSVELNDTD<br>SSAATKKTAAWNSGTSTLTITVNSKKTKDLVFTKENTITVQQYDSNGTKLEGSAVEITKLDEIKNALKGSMTTASTSQVRQNYHQDSEAAI<br>NRQINLELYASYVYLSMSYYFDRDDVALKNFAKYFLHQSHEEREHAEKLMKLQNQRGGRIFLQDIKKPDCDDWESGLNAMECALHLEKNVN<br>QSLLELHKLATDKNDPHLCDFIETHYLNEQVKAIKELGDHVTNLRKMGAPESGLAEYLFDKHTLGDSDNES | 24 |
| OspA Serotype1;<br>LFA-1 replacement<br>Serotype 3-<br>Human Heavy<br>chain ferritin | MDEKNSVSVDLPGEMKVLVSKEKNKDGKYDLIATVDKLELKGTSDKNNGSGVLEGVKADKSKVKLTISDDLGQTTLEVFKEDGKTLVSKKV<br>TSKDKSSTEEKENEKGEVSEKIITRADGTRLEYTGIKSDGSGKAKEVLKG*FALEGTLTD*EKTTLVVKEGTVTLSKNISKSGEVSVELNDTD<br>SSAATKKTAAWNSGTSTLTITVNSKKTKDLVETKENTITVQQYDSNGTKLEGSAVEITKLDEIKNALKGSMTTASTSQVRQNYHQDSEAAI<br>NRQINLELYASYVYLSMSYYFDRDDVALKNFAKYFLHQSHEEREHAEKLMKLQNQRGGRIFLQDIKKPDCDDWESGLNAMECALHLEKNVN<br>QSLLELHKLATDKNDPHLCDFIETHYLNEQVKAIKELGDHVTNLRKMGAPESGLAEYLFDKHTLGDSDNES | 25 |
| OspA Serotype2-<br>Human Heavy<br>chain ferritin | MDEKNSASVDLPGEMKVLVSKEKDKDGKYSLKATVDKIELKGTSDKDNGSGVLEGTKDDKSKAKLTIADDLSKTTFELFKEDGKTLVSRKV<br>SSKDKTSTDEMFNEKGELSAKTMTRENGTKLEYTEMKSDGTGKAKEVLKNFTLEGKVANDKVTLEVKEGTVTLSKEIAKSGEVTVALNDTN<br>TTQATKKTGAWDSKTSTLTISVNSKKTTQLVETKQDTITVQKYDSAGTNLEGTAVEIKTLDELKNALKGSMTTASTSQVRQNYHQDSEAAI<br>NRQINLELYASYVYLSMSYYFDRDDVALKNFAKYFLHQSHEEREHAEKLMKLQNQRGGRIFLQDIKKPDCDDWESGLNAMECALHLEKNVN<br>QSLLELHKLATDKNDPHLCDFIETHYLNEQVKAIKELGDHVTNLRKMGAPESGLAEYLFDKHTLGDSDNES | 26 |
| OspA Serotype 3-<br>Human Heavy<br>chain ferritin | MDEKNSVSVDLPGGMKVLVSKEKDKDGKYSLMATVEKLELKGTSDKSNGSGVLEGEKADKSKAKLTISQDLNQTTFEIFKEDGKTLVSRKV<br>NSKDKSSTEEKENDKGKLSEKVVTRANGTRLEYTEIKNDGSGKAKEVLKGFALEGTLTDGGETKLTVTEGTVTLSKNISKSGEITVALNDT<br>ETTPADKKTGEWKSDTSTLTISKNSQKPKQLVFTKENTITVQNYNRAGNALEGSPAEIKDLAELKAALKGSMTTASTSQVRQNYHQDSEAA | 27 |

TABLE 1-continued (Sequence Table): Description of the Sequences

| Description | Sequences | SEQ ID NO |
|---|---|---|
| OspA Serotype 4-Human Heavy chain ferritin | INRQINLELYASYVVLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES | 28 |
| OspA Serotype 4-Human Heavy chain ferritin | MDEKNSVSVDLPGEMKVLVSKEKDKDGKYSLMATVEKLELKGTSDKSNSGGTLEGEKSDKSKAKLTISEDLSKTTFEIFKEDGKTLVSKKVNSKDKSSIEEKFNAKGELSEKTIVETEIKSDGTGKAEVLKDFALEGTLAADKTTLKVTEGTVVLSKHIPNSGEITVELNDSNSTQATKKTGKWDSNTSTLTISVNSKKTKNIVETKEDTITVQKYDSAGTNLEGNAVEIKTLDELKNALKGSMTTASTSQVRQNYHQDSERAAINRQINLELYASYVVLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES | 29 |
| OspA Serotype 5-Human Heavy chain ferritin | MDEKNSVSVDLPGGMKVLVSKEKDKDGKYSLMATVEKLELKGTSDKNNSGGTLEGEKTDKSKVKLTIAEDLSKTTFEIFKEDGKTLVSKKVTLKDKSSTEEKFNEKGEISEKTIVRANGTRLEYTDIKSDGSGKAKEVLKDFTLEGTLAADGETKLVTEGTVVLSKNILKSGEITVALDDSDTTQATKKTGKWDSKTSTLTISVNSQKTKNLVFTKEDTITVQKTDSAGTNLEGKAVEITTLEKLKDALKGSMTTASTSQVRQNYHQDSEAAINRQINLELYASYVVLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES | 30 |
| OspA Serotype 6-Human Heavy chain ferritin | MDEKNSVSVDLPGGMTVLVSKEKDKDGKYSLEATVDKLELKGTSDKNNGSGTLEGEKTDKSKVKSTIADDLSQTKFEIFKEDGKTLVSKKVTLKDKSSTEEKFNGKGETSEKTIVRANGTRLEYTDIKSDGSGKAKEVLKDFTLEGTLAADGKTTLKVTEGTVVLSKNILKSGEITAALDDSDTTRATKKGTKWDSKTSTLTISVNSQKTKNLVFTKEDTITVQRYDSAGTNLEGKAVEITTLKELKNALKGSMTTASTSQVRQNYHQDSEAAINRQINLELYASYVVLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES | 31 |
| OspA Serotype 7-Human Heavy chain ferritin | MDEKNSVSVDLPGEMKVLVSKEKNDKDGKYSLEATVDKLELKGTSDKNNGSGVLEGVKAAKSAKLTIADDLSQTKFEIFKEDGKTLVSKKVTLKDKSSTEEKFNDKGKLSEKVVTRANGTRLEYTEIQNDGSGKAEVLKSLTLEGTLTADGETKLTVEAGTVVLSKNISESGEITVELKDTETTPADKKSGTWDSKTSTLTIISKNSQKTKQLVFTKENTITVQKYNTAGTKLEGSPAEIKDLEALKAALKGSMTTASTSQVRQNYHQDSEAAINRQINLELYASYVVLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES | 32 |
| OspA Serotype 1; LFA-1 replacement RD2-Pyrococcus furiosus ferritin | MDEKNSVSVDLPGEMKVLVSKEENKDGKYDLIATVDKLELKGTSDKNNGSGVLEGVKADKSKVKLTISDDLGQTTLEVPKEDGKTLVSKKVTSKDKSSTEEKFNEKGEVSEKIITRADGTRLEYTGIKSDGSGKAEVLKGYTLEGQLSDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSMLSERMLKALNDQLNRELYSAYLYFAMAAYPEDLGLEGFANWMKAQAEEEIGHALRFYNYIYDRNGRVELDEIPKPPKEWESPLKAFEAAYEHEKPISKSIYELAALAEEEKDYSTRAFLEWFINEQVEEEASVKKILDKLKFAKDSPQILFMLDKELSARAPKLPGLLMQGGE | 33 |
| OspA Serotype 1; LFA-1 replacement RD1-Pyrococcus furiosus ferritin | MDEKNSVSVDLPGEMKVLVSKEENKDGKYDLIATVDKLELKGTSDKNNGSGVLEGVKADKSKVKLTISDDLGQTTLEVPKEDGKTLVSKKVTSKDKSSTEEKFNEKGEVSEKIITRADGTRLEYTGIKSDGSGKAEVLKGYDLKGELSSEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSMLSERMLKALNDQLNRELYSAYLYFAMAAYPEDLGLEGFANWMKAQAEEEIGHALRFYNYIYDRNGRVELDEIPKPPKEWESPLKAFEAAYEHEKPISKSIYELAALAEEEKDYSTRAFLEWFINEQVEEEASVKKILDKLKFAKDSPQILFMLDKELSARAPKLPGLLMQGGE | 34 |
| OspA Serotype 1; LFA-1 replacement Serotype 3-Pyrococcus furiosus ferritin | MDEKNSVSVDLPGEMKVLVSKEENKDGKYDLIATVDKLELKGTSDKNNGSGVLEGVKADKSKVKLTISDDLGQTTLEVPKEDGKTLVSKKVTSKDKSSTEEKFNEKGEVSEKIITRADGTRLEYTGIKSDGSGKAEVLKGFTLEGKVANEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSMLSERMLKALNDQLNRELYSAYLYFAMAAYPEDLGLEGFANWMKAQAEEEIGHALRFYNYIYDRNGRVELDEIPKPPKEWESPLKAFEAAYEHEKPISKSIYELAALAEEEKDYSTRAFLEWFINEQVEEEASVKKILDKLKFAKDSPQILFMLDKELSARAPKLPGLLMQGGE | 35 |
| OspA Serotype 1; LFA-1 replacement Serotype 3- | MDEKNSVSVDLPGEMKVLVSKEENKEDKDGKYDLIATVDKLELKGTSDKNNGSGVLEGVKADKSKVKLTIVVKEGTLTDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSMLSERMLKALNDQLNRELYSA |  |

TABLE 1-continued (Sequence Table): Description of the Sequences

| Description | Sequences | SEQ ID NO |
|---|---|---|
| Pyrococcus furiosus ferritin | YLYFAMAAYFEDLGLEGFANWMKAQAEEEIGHALRFYNYIYDRNGRVELDEIPKPPKEWESPLKAFEAAYEHEKFISKSIYELAALAEEEK DYSTRAFLEWFINEQVEEEASVKKILDKLKFAKDSPQILFMLDKELSARAPKLPGLLMQGGE | 36 |
| OspA Serotype 2 - Pyrococcus furiosus ferritin | MDEKNSASVDLPGEMKVLVSKEKDKDGKYSLKATVDKIELKGTSDKDNGSGVLEGTKDDKSKAKLTIADDLSKTTFELFKEDGKTLVSRKV SSKDKTSTDEMFNEKGELSAKTMTRENGTKLEYTEMKSDGTGKAKEVLKNFTLEGKVANDKVTLEGKVTLSKEIAKSGEVTVALNDTN TTQATKKTGAWDSKTSTLTISVNSKKTTQLVFTKQDTITVQKYDSAGTNLEGTAVEIKTLDELKNALKGSMLSERMLKALNDQLNRELYSA YLYFAMAAYFEDLGLEGFANWMKAQAEEEIGHALRFYNYIYDRNGRVELDEIPKPPKEWESPLKAFEAAYEHEKFISKSIYELAALAEEEK DYSTRAFLEWFINEQVEEEASVKKILDKLKFAKDSPQILFMLDKELSARAPKLPGLLMQGGE | 37 |
| OspA Serotype 3 - Pyrococcus furiosus ferritin | MDEKNSVSVDLPGGMKVLVSKEKDKDGKYSLMATVEKLELKGTSKSNGSGVLEGEKADKSKAKLTISQDLNQTTFEIFKEDGKTLVSRKV NSKDKSSTEEKENDKGKLSEKVVTRANGTRLEYTEIKNDSGKAKEVLKGFALEGTLTDGGETKLTVFEGTVTLSKNISKSGEITVALNDT ETTPADKKTGEWKSDTSTLTISKNSQKPKQLVFTKENTITVQNYNRAGNALEGSPAEIKDLAELKAALKGSMLSERMLKALNDQLNRELYS AYLYFAMAAYFEDLGLEGFANWMKAQAEEEIGHALRFYNYIYDRNGRVELDEIPKPPKEWESPLKAFEAAYEHEKFISKSIYELAALAEEE KDYSTRAFLEWFINEQVEEEASVKKILDDKLKFAKDSPQILFMLDKELSARAPKLPGLLMQGGE | 38 |
| OspA Serotype 4 - Pyrococcus furiosus ferritin | MDEKNSVSVDLPGEMKVLVSKEKDKDGKYSLMATVDKLELKGTSDKNGSGTLEGEKSDKSKAKLTISEDLSKTTFEIFKEDGKTLVSKKV NSKDKSSIEEKFNAKGELSEKTILRANGTRLEYTEIKSDGTGKAKEVLKDFALEGTLAADKTTLKVTEGTVVLSKHIPNSGEITVALDDSN STQATKKTGKWDSNTSTLTISVNSKKTKNIVFTKEDTITVQKYDSAGTNLEGNAVEIKTLDELKNALKGSMLSERMLKALNDQLNRELYSA YLYFAMAAYFEDLGLEGFANWMKAQAEEEIGHALRFYNYIYDRNGRVELDEIPKPPKEWESPLKAFEAAYEHEKFISKSIYELAALAEEEK DYSTRAFLEWFINEQVEEEASVKKILDKLKFAKDSPQILFMLDKELSARAPKLPGLLMQGGE | 39 |
| OspA Serotype 5 - Pyrococcus furiosus ferritin | MDEKNSVSVDLPGGMKVLVSKEKDKDGKYSLEATVDKLELKGTSDKNNGSGTLEGEKTDKSKVKLTIADLSKTTFEIFKEDGKTLVSKKV TLKDKSSTEEKFNEKGEISEKTIVRANGTRLEYTDIKSDGSGKAKEVLKDFTLEGTLAADGKTTLKVTEGTVVLSKNILKSGEITVALDDS DTTRATKKTGKWDSKTSTLTISVNSQKTKNLVFTKEDTITVQRYDSAGTNLEGKAVEITTLKEELKNALKGSMLSERMLKALNDQLNRELYS AYLYFAMAAYFEDLGLEGFANWMKAQAEEEIGHALRFYNYIYDRNGRVELDEIPKPPKEWESPLKAFEAAYEHEKFISKSIYELAALAEEE KDYSTRAFLEWFINEQVEEEASVKKILDDKLKFAKDSPQILFMLDKELSARAPKLPGLLMQGGE | 40 |
| OspA Serotype 6 - Pyrococcus furiosus ferritin | MDEKNSVSVDLPGGMTVLVSKEKDKDGKYSLEATVDKLELKGTSDKNNGSGTLEGEKTDKSKVKSTIADDLSQTKFEIFKEDGKTLVSKKV TLKDKSSTEEKENGKGETSEKTIVRANGTRLEYTDIKSDGSGKAKEVLKDFTLEGTLAADGKTTLKEELKNALKGSMLSERMLKALNDQLNRELYS AYLYFAMAAYFEDLGLEGFANWMKAQAEEEIGHALRFYNYIYDRNGRVELDEIPKPPKEWESPLKAFEAAYEHEKFISKSIYELAALAEEE KDYSTRAFLEWFINEQVEEEASVKKILDDKLKFAKDSPQILFMLDKELSARAPKLPGLLMQGGE | 41 |
| OspA Serotype 7 - Pyrococcus furiosus ferritin | MDEKNSVSVDLPGEMKVLVSKEKDKDGKYSLEATVDKLELKGTSDKNNGSGVLEGVKAAKSKAKLTIADDLSQTKFEIFKEDGKTLVSKKV TLKDKSSTEEKENDKGKLSEKVVTRANGTRLEYTEIQNDSGSGKAKEVLKSLTLEGTLTADGETKLTVEAGTVTLSKNISESGEITVELKDT ETTPADKKSGTWDSKTSTLTISKNSQKTKQLVFTKENTITVQNTAGTKLEGSPAEIKDLEALKAALKGSMLSERMLKALNDQLNRELYS AYLYFAMAAYFEDLGLEGFANWMKAQAEEEIGHALRFYNYIYDRNGRVELDEIPKPPKEWESPLKAFEAAYEHEKFISKSIYELAALAEEE KDYSTRAFLEWFINEQVEEEASVKKILDDKLKFAKDSPQILFMLDKELSARAPKLPGLLMQGGE | 42 |
| OspA Serotype 1; LFA-1 replacement RD2-Trichoplusia Ni ferritin | MDEKNSVSVDLPGEMKVLVSKEKNDGKYDLIATVDKLELKGTSDKNNGSGVLEGVKADKSKVKLTISDDLGQTTLEVFKEDGKTLVSKKV TSKDKSSTEEKENEKGEVSEKIITRADGTRLEYTGIKSDGSGKAKEVLKGYTLEGQLSDEKTTKLDEIKNALKGSTQCNVNPVQIPKDWITMHRSC SSAATKKTAAWNSGTSTLTITVNSKKTKDLVFTKENTITVQQYDSNGTKLEGSAVEITKLDEIKNALKSTQCNVNPVQIPKDWITMHRSC RNSMRQQIQMEVGASLQYLAMGAHFSKDVVNRPGQFAQLFPDAASEREHAMKLIEYLLMRGELTNDVSSLLQVRPPTRSSWKGGVEALEHA LSMESDVTKSIRNVIKACEDDSEFNDYHLVDYLTGDFLEEQYKGQRDLAGKASTLKKLMDRHEALGEFIPDKKLLGIDV | 43 |
| OspA Serotype 1; LFA-1 replacement RD1-Trichoplusia | MDEKNSVSVDLPGEMKVLVSKEKNDGKYDLIATVDKLELKGTSDKNNGSGVLEGVKADKSKVKLTISDDLGQTTLEVFKEDGKTLVSKKV TSKDKSSTEEKENEKGEVSEKIITRADGTRLEYTGIKSDGSGKAKEVLKGYDLKGELSSEKTTLVVKEGTVTLSKNISKSGEVSVELNDTD SSAATKKTAAWNSGTSTLTITVNSKKTKAAWNSGTSTLTITVNSKKTKDLVFTKENTITVQQYDSNGTKLEGSAVEITKLDEIKNALKSTQCNVNPVQIPKDWITMHRSC | |

TABLE 1-continued (Sequence Table): Description of the Sequences

| Description | Sequences | SEQ ID NO |
|---|---|---|
| Ni ferritin | RNSMRQQIQMEVGASLQYLAMGAHFSKDVVNRPGFAQLFFDAASEREHAMKLIEYLLMRGELTNDVSSLLQVRPPTRSSWKGGVEALEHA<br>LSMESDVTKSIRNVIKACEDDSEFNDYHLVDYLTGDFLEEQYKGQRDLAGKASTLKKLMDRHEALGEFIFDKKLLGIDV | 44 |
| OspA Serotype 1;<br>LFA-1 replacement<br>serotype 2-<br>Trichoplusia<br>Ni ferritin | MDEKNSVSVDLPGEMKVLVSKEKNDGKYDLIATVDKLLELKGTSDKNNGSGVLEGVKADKSKVKLTIGIKGFTLEGKAEVLKGFTLEGKVANEKTTLVVKEGTVTLSKNISKSGEVSVELNDTD<br>TSKDKSSTEEKENEKGEVSEKIITRADGTRLEYTGIKSDGSGKAKEVLKGFTLEGKAEVLKGFALEGTLTDEKTTLVVKEGTVTLSKNISKSGEVSVELNDTD<br>SSAATKKTAAWNSGTSTLTITVNSKKTKDLVFTKENTITVQQYDSNGTKLEGSAVEITKLDEIKNALKGSTQCNVNPVQIPKDWITMHRSC<br>RNSMRQQIQMEVGASLQYLAMGAHFSKDVVNRPGFAQLFFDAASEREHAMKLIEYLLMRGELTNDVSSLLQVRPPTRSSWKGGVEALEHA<br>LSMESDVTKSIRNVIKACEDDSEFNDYHLVDYLTGDFLEEQYKGQRDLAGKASTLKKLMDRHEALGEFIFDKKLLGIDV | 45 |
| OspA Serotype1;<br>LFA-1 replacement<br>serotype 3-<br>Trichoplusia<br>Ni ferritin | MDEKNSVSVDLPGEMKVLVSKEKNDGKYDLIATVDKLLELKGTSDKNNGSGVLEGVKADKSKVKLTISDDLGQTTLEVFKEDGKTLVSKKV<br>TSKDKSSTEEKENEKGEVSEKIITRADGTRLEYTGIKSDGSGKAKEVLKGFALEGTLTDEKTTLVVKEGTVTLSKNISKSGEVSVELNDTD<br>SSAATKKTAAWNSGTSTLTITVNSKKTKDLVFTKENTITVQQYDSNGTKLEGSAVEITKLDEIKNALKGSTQCNVNPVQIPKDWITMHRSC<br>RNSMRQQIQMEVGASLQYLAMGAHFSKDVVNRPGFAQLFFDAASEREHAMKLIEYLLMRGELTNDVSSLLQVRPPTRSSWKGGVEALEHA<br>LSMESDVTKSIRNVIKACEDDSEFNDYHLVDYLTGDFLEEQYKGQRDLAGKASTLKKLMDRHEALGEFIFDKKLLGIDV | 46 |
| OspA Serotype 2-<br>Trichoplusia<br>Ni ferritin | MDEKNSASVDLPGEMKVLVSKEKDKDGKYSLKATVDKIELKGTSDKDDKSKAKLTIADDLSKTTFELFKEDGKTLVSRKV<br>SSKDKTSTDEMFNEKGELSAKTMTRENGTKLEYTEMKSDGTGKAKEVLKNFTLEGKVANDKVTLEVKGTVTLSKEIAKSGEVTVALNDTN<br>TTQATKKTGAWDSKTSTLTISVNSKKTTQLVFTKQDTITVQKDSKPKQLVFTKENTITVQNTNRAGNALEGSPAEIKDLAELKAALKGSTQCNVPIKDMITMRS<br>RNSMRQQIQMEVGASLQYLAMGAHFSKDVVNRPGFAQLFFDAASEREHAMKLIEYLLMRGELTNDVSSLLQVRPPTRSSWKGGVEALEHA<br>LSMESDVTKSIRNVIKACEDDSEFNDYHLVDYLTGDFLEEQYKGQRDLAGKASTLKKLMDRHEALGEFIFDKKLLGIDV | 47 |
| OspA Serotype 3-<br>Trichoplusia<br>Ni ferritin | MDEKNSVSVDLPGGMKVLVSKEKDKDGKYSLMATVEKLELKGTSDKSNGSGVLEGEKADKSKAKLTISQDLNQTTFEIFKEDGKTLVSRKV<br>NSKDKSSTEEKENDKGKLSEKVTRANGTRLEYTEIKNDGSGKAKEVLKGFALEGTLTDGGETKLTVTEGTVTLSKNISKSGEITVALNDT<br>ETTPADKKTGEWKSDTSTLTISKNSQKPKQLVFTKENTITVQNTNRAGNALEGSPAEIKDLAELKAALKGSTQCNVPIKDMITMRS<br>CRNSMRQQIQMEVGASLQYLAMGAHFSKDVVNRPGFAQLFFDAASEREHAMKLIEYLLMRGELTNDVSSLLQVRPPTRSSWKGGVEALEH<br>ALSMESDVTKSIRNVIKACEDDSEFNDYHLVDYLTGDFLEEQYKGQRDLAGKASTLKKLMDRHEALGEFIFDKKLLGIDV | 48 |
| OspA Serotype 4-<br>Trichoplusia<br>Ni ferritin | MDEKNSVSVDLPGEMKVLVSKEKDKDGKYSLMATVDKLELKGTSDKSNGSGTLEGEKSDKSKAKLTISEDLSKTTFEIFKEDGKTLVSKKV<br>NSKDKSSIEEKFNAKGELSEKTILTISVNSKKTKNIVFTKEDTITVQKDSAGTNLEGNAVEIKTLDELKNALKGSTQCNVNPVQIPKDWITMHRSC<br>STQATKKTGKWDSNTSTLTISVNSKKTKNIVFTKEDTITVQKDSAGTNLEGNAVEIKTLDELKNALKGSTQCNVNPVQIPKDWITMHRSC<br>RNSMRQQIQMEVGASLQYLAMGAHFSKDVVNRPGFAQLFFDAASEREHAMKLIEYLLMRGELTNDVSSLLQVRPPTRSSWKGGVEALEHA<br>LSMESDVTKSIRNVIKACEDDSEFNDYHLVDYLTGDFLEEQYKGQRDLAGKASTLKKLMDRHEALGEFIFDKKLLGIDV | 49 |
| OspA Serotype 5-<br>Trichoplusia<br>Ni ferritin | MDEKNSVSVDLPGGMKVLVSKEKDKDGKYSLMATVEKLLELKGTSDKNNGSGTLEGEKTDKSKVKLTIADDLSKTTFEIFKEDGKTLVALDDS<br>TLKDKSSTEEKFNEKGEISEKTIVRANGTRLEYTDIKSDGSGKAKEVLKDFTLEGTLAADGKTTLKVTEGTVTLVLSKNILKSGEITVALLDDS<br>DTTQATKKTGKWDSKTSTLTISVNSQKTKNLVFTKEDTITVQRDYDSAGTNLEGKAVEITTLEKLKDALKGSTQCNVNPVQIPKDWITMHRS<br>CRNSMRQQIQMEVGASLQYLAMGAHFSKDVVNRPGFAQLFFDAASEREHAMKLIEYLLMRGELTNDVSSLLQVRPPTRSSWKGGVEALEH<br>ALSMESDVTKSIRNVIKACEDDSEFNDYHLVDYLTGDFLEEQYKGQRDLAGKASTLKKLMDRHEALGEFIFDKKLLGIDV | 50 |
| OspA Serotype 6-<br>Trichoplusia<br>Ni ferritin | MDEKNSVSVDLPGGMTVLVSKEKDKDGKYSLEATVDKLLELKGTSDKNNGSGTLEGEKTDKSKVKSTIADDLSQTKFEIFKEDGKTLVSKKV<br>TLKDKSSTEEKENGKGETSEKTIVRANGTRLEYTDIKSDGSGKAKEVLKDFTLEGTLAADGKTTLKVTEGTVTLVLSKNILKSGEITAALDDS<br>DTTRATKKTGKWDSKTSTLTISVNSQKTKNLVFTKEDTITVQRDYDSAGTNLEGKAVEITTLKELKNALKGSTQCNVNPVQIPKDWITMHRS<br>CRNSMRQQIQMEVGASLQYLAMGAHFSKDVVNRPGFAQLFFDAASEREHAMKLIEYLLMRGELTNDVSSLLQVRPPTRSSWKGGVEALEH<br>ALSMESDVTKSIRNVIKACEDDSEFNDYHLVDYLTGDFLEEQYKGQRDLAGKASTLKKLMDRHEALGEFIFDKKLLGIDV | 51 |
| OspA Serotype 7-<br>Trichoplusia<br>Ni ferritin | MDEKNSVSVDLPGEMKVLVSKEKDKDGKYSLEATVDKLLELKGTSDKNNGSGVLEGVKAAKSKAKLTIADDLSQTKFEIFKEDGKTLVSKKV<br>TLKDKSSTEEKENDKGKLSEKVVTRANGTRLEYTEIQNDGSGKAKEVLKSLTLEGTLTADGETKLTVEAGTVTLSKNISESGEITVELKDT<br>ETTPADKKSGTWDSKTSTLTISKNSQKTKLVFTKENTITVQKYNTAGTKLEGSPAEIKDLEALKAALKGSTQCNVNPVQIPKDWITMHRS | 51 |

TABLE 1-continued (Sequence Table): Description of the Sequences

| Description | Sequences | SEQ ID NO |
|---|---|---|
| Serotype 1 LFA-1 replacement RD2 OspA-ferritin | CRNSMRQQIQMEVGASLQYLAMGAHFSKDVVNRPGFAQLFFDAASEEREHAMKLIEYLLMRGELTNDVSSLLQVRPPTRSSWKGGVEALEH ALSMESDVTKSIRNVIKACEDDSEFNDYHLVDYLTGDFLEEQYKGQRDLAGKASTLKKLLMDRHEALGEFIFDKKLLGIDV KVKLTISDDLGQTTLEVEKEDGKTLVSKKVTSKDKSSTEKENEKGEVSEKIITRADGTRLEYTGIKSDGSGKAKEVLKGYTLEGQLSDEK TTLVVKEGTVTLSKNISKSGEVSVELNDTDSSAATKKTAAWNSGTSTLTITVNSKKTKDLVFTKENTITVQQYDSNGTKLEGSAVEITKLD EIKNALKGSESQVRQQFSKDIEKLLNEQVNKEMQSSNLYMSMSSWSYTHSLDGAGLFLFDHAAEEYEHAKKLIIFLNENNVPVQLTSISAP EHKFEGLTQIFQKAYEHEQHISESINNIVDHAIKCKDHATFNFLQMYVAEQHEEEVLFKDILDKIELIGNENHGLYLADQYVKGIAKSRKS | 52 |
| Serotype 1 | MDSKGSSQKGSRLLLLLLVVSNLLLPQGVLAMDEKNSVSVDLPGEMKVLVSKEKNDGKYDLIATVDKLELKGTSDKNQGSGVLEGVKADKS | 53 |
| Non-glycosylated LFA-1 replacement RD2 OspA-ferritin | KVKLTISDDLGQTTLEVEKEDGKTLVSKKVTSKDKSSTEKENEKGEVSEKIITRADGTRLEYTGIKSDGSGKAKEVLKGYTLEGQLSDEK TTLVVKEGTVTLSKQLSKSGEVSVELQDTDSSAATKKTAAWNSGTSTLTITVNSKKTKDLVFTKENTITVQQYDSQGTKLEGSAVEITKLD EIKNALKGSESQVRQQFSKDIEKLLNEQVNKEMQSSNLIYMSMSSWSYTHSLDGAGLFLFDHAAEEYEHAKKLIIFLNENHGLYADQYVKGIAKSRKS EHKFEGLTQIFQKAYEHEQHISESINNIVDHAIKCKDHATFNFLQMYVAEQHEEEVLFKDILDKIELIGNENHGLYLADQYVKGIAKSRKS | 54 |
| OspA-ferritin Serotype 1 with LFA-1 site replaced with Serotype 2 | MDSKGSSQKGSRLLLLLLVVSNLLLPQGVLAMDEKNSVSVDLPGEMKVLVSKEKNDGKYDLIATVDKLELKGTSDKNNGSGVLEGVKADKS KVKLTISDDLGQTTLEVEKEDGKTLVSKKVTSKDKSSTEKENEKGEVSEKIITRADGTRLEYTGIKSDGSGKAKEVLKGFTLEGKVANEK TTLVVKEGTVTLSKNISKSGEVSVELNDTDSSAATKKTAAWNSGTSTLTITVNSKKTKDLVFTKENTITVQQYDSNGTKLEGSAVEITKLD EIKNALKGSESQVRQQFSKDIEKLLNEQVNKEMQSSNLYMSMSSWSYTHSLDGAGLFLFDHAAEEYEHAKKLIIFLNENNVPVQLTSISAP EHKFEGLTQIFQKAYEHEQHISESINNIVDHAIKCKDHATFNFLQMYVAEQHEEEVLFKDILDKIELIGNENHGLYLADQYVKGIAKSRKS | 55 |
| Non-glycosylated OspA-ferritin Serotype 1 with LFA-1 site replaced with Serotype 3 | MDSKGSSQKGSRLLLLLLVVSNLLLPQGVLAMDEKNSVSVDLPGEMKVLVSKEKNDGKYDLIATVDKLELKGTSDKNQGSGVLEGVKADKS KVKLTISDDLGQTTLEVEKEDGKTLVSKKVTSKDKSSTEKENEKGEVSEKIITRADGTRLEYTGIKSDGSGKAKEVLKGFTLEGKVANEK TTLVVKEGTVTLSKQLSKSGEVSVELQDTDSSAATKKTAAWNSGTSTLTITVNSKKTKDLVFTKENTITVQQYDSQGTKLEGSAVEITKLD EIKNALKGSESQVRQQFSKDIEKLLNEQVNKEMQSSNLYMSMSSWSYTHSLDGAGLFLFDHAAEEYEHAKKLIIFLNENNVPVQLTSISAP EHKFEGLTQIFQKAYEHEQHISESINNIVDHAIKCKDHATFNFLQMYVAEQHEEEVLFKDILDKIELIGNENHGLYLADQYVKGIAKSRKS | 56 |
| OspA-ferritin serotype 1 with LFA-1 site replaced with Serotype 3 | MDSKGSSQKGSRLLLLLLVVSNLLLPQGVLAMDEKNSVSVDLPGEMKVLVSKEKNDGKYDLIATVDKLELKGTSDKNNGSGVLEGVKADKS KVKLTISDDLGQTTLEVEKEDGKTLVSKKVTSKDKSSTEKENEKGEVSEKIITRADGTRLEYTGIKSDGSGKAKEVLKGFALEGTLTDEK TTLVVKEGTVTLSKNISKSGEVSVELNDTDSSAATKKTAAWNSGTSTLTITVNSKKTKDLVFTKENTITVQQYDSNGTKLEGSAVEITKLD EIKNALKGSESQVRQQFSKDIEKLLNEQVNKEMQSSNLYMSMSSWSYTHSLDGAGLFLFDHAAEEYEHAKKLIIFLNENNVPVQLTSISAP EHKFEGLTQIFQKAYEHEQHISESINNIVDHAIKCKDHATFNFLQMYVAEQHEEEVLFKDILDKIELIGNENHGLYLADQYVKGIAKSRKS | |
| Non-glycosylated OspA-ferritin serotype 1 with | MDSKGSSQKGSRLLLLLLVVSNLLLPQGVLAMDEKNSVSVDLPGEMKVLVSKEKNDGKYDLIATVDKLELKGTSDKNQGSGVLEGVKADKS KVKLTISDDLGQTTLEVEKEDGKTLVSKKVTSKDKSSTEKENEKGEVSEKIITRADGTRLEYTGIKSDGSGKAKEVLKGFALEGTLTDEK TTLVVKEGTVTLSKQLSKSGEVSVELQDTDSSAATKKTAAWNSGTSTLTITVNSKKTKDLVFTKENTITVQQYDSQGTKLEGSAVEITKLD | 57 |

TABLE 1-continued

| (Sequence Table): Description of the Sequences | | |
|---|---|---|
| Description | Sequences | SEQ ID NO |
| LFA-1 site replaced<br>with Serotype 3 | EIKNALKGSESQVRQQFSKDIEKLLNEQVNKEMQSSNLYMSMSSWSYTHSLDGAGLFLFDHAAEEYEHAKKLIIFLNENNVPVQLTSISAP<br>EHKFEGLTQIFQKAYEHEQHISESINNIVDHAIKCKDHATFNFLQWYVAEQHEEEVLFKDILDKIELIGNENHGLYLADQYVKGIAKSRKS | |
| OspA-ferritin<br>Serotype 1 with<br>LFA-1 site replaced<br>with RD1 | MDSKGSSQKGSRLLLLLVVSNLLLPQGVLAMDEKNSVSVDLPGEMKVLVSKEKNKDGKYDLIATVDKLELKGTSDKNNGSGVLEGVKADKS<br>KVKLTISDDLGQTTLEVEKEDGKTLVSKKVTSKDKSSTEEKENEKGEVSEKIITRADGTRLEYTGIKSDGSGKAKEVLKG*YDLKGELSS*EK<br>TTLVVKEGTVTLSKNISKSGEVSVELNDTDSSAATKKTAAWNSGTSTLTITVNSKKTKDLVFTKENTITVQQYDSNGTKLEGSAVEITKLD<br>EIKNALKGSESQVRQQFSKDIEKLLNEQVNKEMQSSNLYMSMSSWSYTHSLDGAGLFLFDHAAEEYEHAKKLIIFLNENNVPVQLTSISAP<br>EHKFEGLTQIFQKAYEHEQHISESINNIVDHAIKCKDHATFNFLQWYVAEQHEEEVLFKDILDKIELIGNENHGLYLADQYVKGIAKSRKS | 58 |
| Non-glycosylated<br>OspA-ferritin<br>Serotype 1 with<br>LFA-1 site replaced<br>with RD1 | MDSKGSSQKGSRLLLLLVVSNLLLPQGVLAMDEKNSVSVDLPGEMKVLVSKEKNKDGKYDLIATVDKLELKGTSDKNQGSGVLEGVKADKS<br>KVKLTISDDLGQTTLEVEKEDGKTLVSKKVTSKDKSSTEEKENEKGEVSEKIITRADGTRLEYTGIKSDGSGKAKEVLKG*YDLKGELSS*EK<br>TTLVVKEGTVTLSKQLSKSGEVSVELQDTDSSAATKKTAAWNSGTSTLTITVNSKKTKDLVFTKENTITVQQYDSQGTKLEGSAVEITKLD<br>EIKNALKGSESQVRQQFSKDIEKLLNEQVNKEMQSSNLYMSMSSWSYTHSLDGAGLFLFDHAAEEYEHAKKLIIFLNENNVPVQLTSISAP<br>EHKFEGLTQIFQKAYEHEQHISESINNIVDHAIKCKDHATFNFLQWYVAEQHEEEVLFKDILDKIELIGNENHGLYLADQYVKGIAKSRKS | 59 |
| Non-glycosylated,<br>OspA-ferritin<br>Serotype 1,<br>LFA-1 replacement<br>RD2, 1 × GGGS<br>(SEQ ID NO: 443) linker | MDSKGSSQKGSRLLLLLVVSNLLLPQGVLAMDEKNSVSVDLPGEMKVLVSKEKNKDGKYDLIATVDKLELKGTSDKNQGSGVLEGVKADKS<br>KVKLTISDDLGQTTLEVEKEDGKTLVSKKVTSKDKSSTEEKENEKGEVSEKIITRADGTRLEYTGIKSDGSGKAKEVLKG*YTLEGQLSD*EK<br>TTLVVKEGTVTLSKQLSKSGEVSVELQDTDSSAATKKTAAWNSGTSTLTITVNSKKTKDLVFTKENTITVQQYDSQGTKLEGSAVEITKLD<br>EIKNALKGGGS*ESQVRQQF*SKDIEKLLNEQVNKEMQGSNLYMSMSSWSYTHSLDGAGLELFDHAAEEYEHAKKLIIFLNENNVPVQLTSIS<br>APEHKFEGLTQIFQKAYEHEQHISESINNIVDHAIKCKDHATFNFLQWYVAEQHEEEVLFKDILDKIELIGNENHGLYLADQYVKGIAKSR<br>KS | 60 |
| Non-glycosylated,<br>OspA-ferritin<br>Serotype 1,<br>LFA-1 replacement<br>RD2, 2 × GGGS<br>(SEQ ID NO: 444) linker | MDSKGSSQKGSRLLLLLVVSNLLLPQGVLAMDEKNSVSVDLPGEMKVLVSKEKNKDGKYDLIATVDKLELKGTSDKNQGSGVLEGVKADKS<br>KVKLTISDDLGQTTLEVEKEDGKTLVSKKVTSKDKSSTEEKENEKGEVSEKIITRADGTRLEYTGIKSDGSGKAKEVLKG*YTLEGQLSD*EK<br>TTLVVKEGTVTLSKQLSKSGEVSVELQDTDSSAATKKTAAWNSGTSTLTITVNSKKTKDLVFTKENTITVQQYDSQGTKLEGSAVEITKLD<br>EIKNALKGGGSESQVRQQFSKDIEKLLNEQVNKEMQGSNLYMSMSSWSYTHSLDGAGLFLFDHAAEEYEHAKKLIIFLNENNVPVQL<br>TSISAPEHKFEGLTQIFQKAYEHEQHISESINNIVDHAIKCKDHATFNFLQWYVAEQHEEEVLFKDILDKIELIGNENHGLYLADQYVKGI<br>AKSRKS | 61 |
| Non-glycosylated,<br>OspA-ferritin<br>Serotype 1,<br>LFA-1 replacement | MDSKGSSQKGSRLLLLLVVSNLLLPQGVLAMDEKNSVSVDLPGEMKVLVSKEKNKDGKYDLIATVDKLELKGTSDKNQGSGVLEGVKADKS<br>KVKLTISDDLGQTTLEVEKEDGKTLVSKKVTSKDKSSTEEKENEKGEVSEKIITRADGTRLEYTGIKSDGSGKAKEVLKG*YTLEGQLSD*EK<br>TTLVVKEGTVTLSKQLSKSGEVSVELQDTDSSAATKKTAAWNSGTSTLTITVNSKKTKDLVFTKENTITVQQYDSQGTKLEGSAVEITKLD<br>EIKNALKGGGSGGGSGGGSGGGSGGGS*ESQVRQQF*SKDIEKLLNEQVNKEMQGSNLYMSMSSWSYTHSLDGAGLELFDHAAEEYEHAKKLI | 62 |

TABLE 1-continued (Sequence Table): Description of the Sequences

| Description | Sequences | SEQ ID NO |
|---|---|---|
| RD2, 5 × GGGS (SEQ ID NO: 445) linker | IFLNENNVPVQLTSISAPEHKFEGLTQIFQKAYEHEQHISESINNIVDHAIKCKDHATFNFLQWYVAEQHEEEVLFKDILDKIELIGNENH GLYLADQYVKGIAKSRKS | |
| Non-glycosylated (Alanine) OspA-ferritin, LFA1 replacement RD2, Serotype 1 | MDSKGSSQKGSRLLLLLVVSNLLLPQGVLAMDEKNSVSVDLPGEMKVLVSKEKNKDGKYDLIATVDKLELKGTSDKNNGAGVLEGVKADKS KVKLTISDDLGQTTLEVEKEDGKTLVSKKVTSKDKSSTEEKENEKGEVSEKIITRADGTRLEYTGIKSDGSGKAKEVLKGYTLEGQLSDEK TTLVVKEGTVTLSKNIAKSGEVSVELNDADSSAATKKTAAWNSGTSTLTITVNSKKTKDLVFTKENTITVQQYDSNGAKLEGSAVEITKLD EIKNALKGSESQVRQQFSKDIEKLLNEQVNKEMQSSNLYMSMSSWSYTHSLDGAGLFLFDHAAEEYEHAKKLIIFLNENNVPVQLTSISAP EHKFEGLTQIFQKAYEHEQHISESINNIVDHAIKCKDHATFNFLQWYVAEQHEEEVLFKDILDKIELIGNENHGLYLADQYVKGIAKSRKS | 63 |
| OspA-ferritin Serotype 1 | MDSKGSSQKGSRLLLLLVVSNLLLPQGVLAMDEKNSVSVDLPGEMKVLVSKEKNKDGKYDLIATVDKLELKGTSDKNNGSGVLEGVKADKS KVKLTISDDLGQTTLEVFKEDGKTLVSKKVTSKDKSSTEEKFNEKGEVSEKIITRADGTRLEYTGIKSDGSGKAKEVLKGYVLEGTLTAEK TTLVVKEGTVTLSKNISKSGEVSVELNDTDSSAATKKTAAWNSGTSTLTITVNSKKTKDLVFTKENTITVQQYDSNGTKLEGSAVEITKLD EIKNALKGSESQVRQQFSKDIEKLLNEQVNKEMQSSNLYMSMSSWSYTHSLDGAGLFLFDHAAEEYEHAKKLIIFLNENNVPVQLTSISAP EHKFEGLTQIFQKAYEHEQHISESINNIVDHAIKCKDHATFNFLQWYVAEQHEEEVLFKDILDKIELIGNENHGLYLADQYVKGIAKSRKS | 64 |
| Serotype 2 OspA-ferritin | MDSKGSSQKGSRLLLLLVVSNLLLPQGVLAMDEKNSASVDLPGEMKVLVSKEKDKDGKYSLKATVDKIELKGTSDKDNGSGVLEGTKDDKS KAKLTIADDLSKTTFELFKEDGKTLVSRKVSSKDKTSTDEMFNEKGELSAKTMTRENGTKLEYTEMKSDGTGKAKEVLKNFTLEGKVANDK VTLEVKEGTVTLSKEIAKSGEVTVALNDTNTTQATKKTGAWDSKTSTLTISVNSKKTTQLVFTKQDTITVQKYDSAGTNLEGTAVEIKTLD ELKNALKGSESQVRQQFSKDIEKLLNEQVNKEMQSSNLYMSMSSWSYTHSLDGAGLFLFDHAAEEYEHAKKLIIFLNENNVPVQLTSISAP EHKFEGLTQIFQKAYEHEQHISESINNIVDHAIKCKDHATFNFLQWYVAEQHEEEVLFKDILDKIELIGNENHGLYLADQYVKGIAKSRKS | 65 |
| Non-glycosylated OspA-ferritin Serotype 2 | MDSKGSSQKGSRLLLLLVVSNLLLPQGVLAMDEKNSASVDLPGEMKVLVSKEKDKDGKYSLKATVDKIELKGTSDKDQGSGVLEGTKDDKS KAKLTIADDLSKTTFELFKEDGKTLVSRKVSSKDKTSTDEMENEKGELSAKTMTREQGTKLEYTEMKSDGTGKAKEVLKQFTLEGKVANDK VTLEVKEGTVTLSKEIAKSGEVTVALQDTQTTQATKKTGAWDSKTSTLTISVNSKKTTQLVETKQDTITVQKYDSAGTNLEGTAVEIKTLD ELKNALKGSESQVRQQFSKDIEKLLNEQVNKEMQSSNLYMSMSSWSYTHSLDGAGLFLFDHAAEEYEHAKKLIIFLNENNVPVQLTSISAP EHKFEGLTQIFQKAYEHEQHISESINNIVDHAIKCKDHATFNFLQWYVAEQHEEEVLFKDILDKIELIGNENHGLYLADQYVKGIAKSRKS | 66 |
| Serotype 3 OspA-ferritin | MDSKGSSQKGSRLLLLLVVSNLLLPQGVLAMDEKNSVSVDLPGGMKVLVSKEKDKDGKYSLMATVEKLELKGTSDKSNGSGVLEGEKADKS KAKLTISQDLNQTTFEIFKEDGKTLVSRKVNSKDKSSTEEKENDKGKLSEKVVTRANGTRLEYTEIKNDGSGKAKEVLKGFALEGTLTDGG ETKLTVTEGTVTLSKNISKSGEITVALNDTETTPADKKTGEWKSDTSTLTISKNSQKPKQLVFTKENTITVQNYNRAGNALEGSPAEIKDL AELKNALKGSESQVRQQFSKDIEKLLNEQVNKEMQSSNLYMSMSSWSYTHSLDGAGLFLFDHAAEEYEHAKKLIIFLNENNVPVQLTSISA PEHKFEGLTQIFQKAYEHEQHISESINNIVDHAIKCKDHATFNFLQWYVAEQHEEEVLFKDILDKIELIGNENHGLYLADQYVKGIAKSRK S | 67 |

TABLE 1-continued (Sequence Table): Description of the Sequences

| Description | Sequences | SEQ ID NO |
|---|---|---|
| Non-glycosylated OspA-ferritin Serotype 3 | MDSKGSSQKGSRLLLLLVVSNLLLPQGVLAMDEKNSVSVDLPGGMKVLVSKEKDKDGKYSLMATVEKLELKGTSDKSQGSGVLEGEKADKS<br>KAKLTISQDLQQTTFEIFKEDGKTLVSRKVNSKDKSSTEEKENDKGKLSEKVVTRAQGTRLEYTEIKNDGSGKAKEVLKGFALEGTLTDGG<br>ETKLTVTEGTVTLSKQTSKSGEITVALQDTETTPADKKTGEWKSDTSTLTISKNSQKPKQLVFTKENTITVQNYNRAGNALEGSPAEIKDL<br>AELKAALKGSESQVRQQFSKDIEKLLNEQVNKEMQGSNLYMSMSSWSYTHSLDGAGLELFDHAAEEYEHAKKLIIFLNENNVPVQLTSISA<br>PEHKFEGLTQIFQKAYEHEQHISESINNIVDHAIKCKDHATFNFLQWYVAEQHEEEVLFKDILDKIELIGNENHGLYLADQYVKGIAKSRK<br>S | 68 |
| Serotype 4 OspA-ferritin | MDSKGSSQKGSRLLLLLVVSNLLLPQGVLAMDEKNSVSVDLPGEMKVLVSKEKDKDGKYSLMATVDKLELKGTSDKSNGSGTLEGEKSDKS<br>KAKLTISEDLSKTTFEIFKEDGKTLVSKKVNSKDKSSIEEKFNAKGELSEKTILRANGTRLEYTEIKSDGTGKAKEVLKDFALEGTLAADK<br>TTLKVTEGTVVLSKHIPNSGEITVELNDSNSTQATKKTGKWDSNTSTLTISVNSKKTKNIVFTKEDTITVQKYDSAGTNLEGNAVEIKTLD<br>ELKNALKGSESQVRQQFSKDIEKLLNEQVNKEMQSSNLYMSMSSWSYTHSLDGAGLFLFDHAAEEYEHAKKLIIFLNENNVPVQLTSISAP<br>EHKFEGLTQIFQKAYEHEQHISESINNIVDHAIKCKDHATFNFLQWYVAEQHEEEVLFKDILDKIELIGNENHGLYLADQYVKGIAKSRKS | 69 |
| Non-glycosylated OspA-ferritin Serotype 4 | MDSKGSSQKGSRLLLLLVVSNLLLPQGVLAMDEKNSVSVDLPGEMKVLVSKEKDKDGKYSLMATVDKLELKGTSDKSQGSGTLEGEKSDKS<br>KAKLTISEDLSKTTFEIFKEDGKTLVSKKVNSKDKSSIEEKENAKGELSEKTILRAQGTRLEYTEIKSDGTGKAKEVLKDFALEGTLAADK<br>TTLKVTEGTVVLSKHIPNSGEITVELQDSQGTQATKKTGKWDSQTSTLTISVNSKKTKNIVETKEDTITVQKYDSAGTNLEGNAVEIKTLD<br>ELKNALKGSESQVRQQFSKDIEKLLNEQVNKEMQGSNLYMSMSSWSYTHSLDGAGLELFDHAAEEYEHAKKLIIFLNENNVPVQLTSISAP<br>EHKFEGLTQIFQKAYEHEQHISESINNIVDHAIKCKDHATFNFLQWYVAEQHEEEVLFKDILDKIELIGNENHGLYLADQYVKGIAKSRKS | 70 |
| OspA-ferritin Serotype 5 | MDSKGSSQKGSRLLLLLVVSNLLLPQGVLAMDEKNSVSVDLPGGMKVLVSKEKDKDGKYSLMATVEKLELKGTSDKNNGSGTLEGEKTDKS<br>KVKLTIAEDLSKTTFEIFKEDGKTLVSKKVTLKDKSSTEEKFNEKGEISEKTIVRANGTRLEYTDIKSDGSGKAKEVLKDFTLEGTLAADG<br>KTTLKVTEGTVVLSKNILKSGEITVALDDSDTTQATKKTGKWDSKTSTLTISVNSQKTKNLVFTKEDTITVQKYDSAGTNLEGKAVEITTL<br>EKLKDALGSESQVRQQFSKDIEKLLNEQVNKEMQSSNLYMSMSSWSYTHSLDGAGLFLFDHAAEEYEHAKKLIIFLNENNVPVQLTSISA<br>PEHKFEGLTQIFQKAYEHEQHISESINNIVDHAIKCKDHATFNFLQWYVAEQHEEEVLFKDILDKIELIGNENHGLYLADQYVKGIAKSRK<br>S | 71 |
| Serotype 5 Non-glycosylated OspA-ferritin | MDSKGSSQKGSRLLLLLVVSNLLLPQGVLAMDEKNSVSVDLPGGMKVLVSKEKDKDGKYSLMATVEKLELKGTSDKNQGSGTLEGEKTDKS<br>KVKLTIAEDLSKTTFEIFKEDGKTLVSKKVTLKDKSSTEEKENEKGEISEKTIVRAQGTRLEYTDIKSDGSGKAKEVLKDFTLEGTLAADG<br>KTTLKVTEGTVVLSKNILKSGEITVALDDSDTTQATKKTGKWDSKTSTLTISVNSQKTKNLVFTKEDTITVQKYDSAGTNLEGKAVEITTL<br>EKLKDALKGSESQVRQQFSKDIEKLLNEQVNKEMQSSNLYMSMSSWSYTHSLDGAGLFLFDHAAEEYEHAKKLIIFLNENNVPVQLTSISA<br>PEHKFEGLTQIFQKAYEHEQHISESINNIVDHAIKCKDHATFNFLQWYVAEQHEEEVLFKDILDKIELIGNENHGLYLADQYVKGIAKSRK<br>S | 72 |

TABLE 1-continued

| (Sequence Table): Description of the Sequences | | |
|---|---|---|
| Description | Sequences | SEQ ID NO |
| Serotype 6<br>Non-glycosylated<br>OspA-ferritin | MDSKGSSQKGSRLLLLLVVSNLLLPQGVLAMDEKNSVSVDLPGGMTVLVSKEKDKDGKYSLEATVDKLELKGTSDKNQGSGTLEGEKTDKS<br>KVKSTIADDLSQTKFEIFKEDGKTLVSKKVTLKDKSSTEEKENGKGETSEKTIVRAQGTRLEYTDIKSDGSGKAKEVLKDFTLEGTLAADG<br>KTTLKVTEGTVVLSKNILKSGEITAALDDSDTTRATKKTGKWDSKTSTLTISVNSQKTKNLVFTKEDTITVQRYDSAGTNLEGKAVEITTL<br>KELKNALKGSESQVRQQFSKDIEKLLNEQVNKEMQSSNLYMSMSSWSYTHSLDGAGLFLFDHAAEEYEHAKKLIIFLNENNVPVQLTSISA<br>PEHKFEGLTQIFQKAYEHEQHISESINNIVDHAIKCKDHATFNFLQWYVAEQHEEEVLFKDILDKIELIGNENHGLYLADQYVKGIAKSRK<br>S | 73 |
| Serotype 6<br>OspA-ferritin | MDSKGSSQKGSRLLLLLVVSNLLLPQGVLAMDEKNSVSVDLPGGMTVLVSKEKDKDGKYSLEATVDKLELKGTSDKNNGSGTLEGEKTDKS<br>KVKSTIADDLSQTKFEIFKEDGKTLVSKKVTLKDKSSTEEKENGKGETSEKTIVRANGTRLEYTDIKSDGSGKAKEVLKDFTLEGTLAADG<br>KTTLKVTEGTVVLSKNILKSGEITAALDDSDTTRATKKTGKWDSKTSTLTISVNSQKTKNLVFTKEDTITVQRYDSAGTNLEGKAVEITTL<br>KELKNALKGSESQVRQQFSKDIEKLLNEQVNKEMQSSNLYMSMSSWSYTHSLDGAGLFLFDHAAEEYEHAKKLIIFLNENNVPVQLTSISA<br>PEHKFEGLTQIFQKAYEHEQHISESINNIVDHAIKCKDHATFNFLQWYVAEQHEEEVLFKDILDKIELIGNENHGLYLADQYVKGIAKSRK<br>S | 74 |
| OspA-ferritin<br>Serotype 7 | MDSKGSSQKGSRLLLLLVVSNLLLPQGVLAMDEKNSVSVDLPGEMKVLVSKEKDKDGKYSLEATVDKLELKGTSDKNNGSGVLEGVKAAKS<br>KAKLTIADDLSQTKFEIFKEDGKTLVSKKVTLKDKSSTEEKENDKGKLSEKVVTRANGTRLEYTEIQNDGSGKAKEVLKSLTLEGTLTADG<br>ETKLTVEAGTVTLSKNISESGEITVELKDTETTPADKKSGTWDSKTSTLTISKNSQKTKQLVFTKENTITVQKYNTAGTKLEGSPAEIKDL<br>EALKAALKGSESQVRQQFSKDIEKLLNEQVNKEMQSSNLYMSMSSWSYTHSLDGAGLFLFDHAAEEYEHAKKLIIFLNENNVPVQLTSISA<br>PEHKFEGLTQIFQKAYEHEQHISESINNIVDHAIKCKDHATFNFLQWYVAEQHEEEVLFKDILDKIELIGNENHGLYLADQYVKGIAKSRK<br>S | 75 |
| Serotype 7<br>Non-glycosylated<br>OspA-ferritin | MDSKGSSQKGSRLLLLLVVSNLLLPQGVLAMDEKNSVSVDLPGEMKVLVSKEKDKDGKYSLEATVDKLELKGTSDKNQGSGVLEGVKAAKS<br>KAKLTIADDLSQTKFEIFKEDGKTLVSKKVTLKDKSSTEEKFNDKGKLSEKVVTRAQGTRLEYTEIQNDGSGKAKEVLKSLTLEGTLTADG<br>ETKLTVEAGTVTLSKQISESGEITVELKDTETTPADKKSGTWDSKTSTLTISKNSQKTKQLVFTKENTITVQKYNTAGTKLEGSPAEIKDL<br>EALKAALKGSESQVRQQFSKDIEKLLNEQVNKEMQSSNLYMSMSSWSYTHSLDGAGLFLFDHAAEEYEHAKKLIIFLNENNVPVQLTSISA<br>PEHKFEGLTQIFQKAYEHEQHISESINNIVDHAIKCKDHATFNFLQWYVAEQHEEEVLFKDILDKIELIGNENHGLYLADQYVKGIAKSRK<br>S | 76 |
| Amino acids 165-173 of OspA serotype 1 | YVLEGTLTA | 77 |
| Sequence of hLFA-1 having homology to amino acids 165-173 of OspA serotype 1 | YVIEGTSKQ | 78 |
| S2 sequence from OspA 2 serotype | FTLEGKVAN | 79 |

TABLE 1-continued

| (Sequence Table): Description of the Sequences | | |
|---|---|---|
| Description | Sequences | SEQ ID NO |
| S3 sequence from OspA serotype 3 | FALEGTLTD | 80 |
| RD2 | YTLEGQLSD | 81 |
| RD1 | YDLKGELSS | 82 |
| Exemplary OspA serotype 1 (strain WP_010890378.1) | MKKYLLGIGL ILALIACKQN VSSLDEKNSV SVDLPGEMKV LVSKEKNKDG KYDLIATVDK LELKGTSDKN NGSGVLEGVK<br>ADKSKVKLTI SDDLGQTTLE VFKEDGKTLV SKKVTSKDKS STEEKFNEKG EVSEKIITRA DGTRLEYTGI KSDGSGKAKE<br>VLKGYVLEGT LTAEKTTLVV KEGTVTLSKN ISKSGEVSVE LNDTDSSAAT KKTAAWNSGT STLTITVNSK KTKDLVFTKE<br>NTITVQQYDS NGTKLEGSAV EITKLDEIKN ALK | 83 |
| Exemplary OspA serotype 2 (strain WP_011703777.1) | MKKYLLGIGL ILALIACKQN VSSLDEKNSA SVDLPGEMKV LVSKEKDKDG KYSLKATVDK IELKGTSDKD NGSGVLEGTK<br>DDKSKAKLTI ADDLSKTTFE LFKEDGKTLV SRKVSSKDKT STDEMFNEKG ELSAKTMTRE NGTKLEYTEM KSDGTGKAKE<br>VLKNFTLEGK VANDKVTLEV KEGTVTLSKE IAKSGEVTVA LNDTNTTQAT KKTGAWDSKT STLTISVNSK KTTQLVFTKQ<br>DTITVQKYDS AGTNLEGTAV EIKTLDELKN ALK | 84 |
| Exemplary OspA serotype 3 (strain CAA56549.1) | MKKYLLGIGL ILALIACKQN VSSLDEKNSV SVDLPGGMKV LVSKEKDKDG KYSLMATVEK LELKGTSDKS NGSGVLEGEK<br>ADKSKAKLTI SQDLNQTTFE IFKEDGKTLV SRKVNSKDKS STEEKFNDKG KLSEKVVTRA NGTRLEYTEI KNDGSGKAKE<br>VLKGFALEGT LTDGGETKLT VTEGTVTLSK NISKSGEITV ALNDTETTPA DKKTGEWKSD TSTLTISKNS QKPKQLVFTK<br>ENTITVQNYN RAGNALEGSP AEIKDLAELK AALK | 85 |
| Exemplary OspA serotype 4 (strain WP_011187157.1) | MKKYLLGIGL ILALIACKQN VSSLDEKNSV SVDLPGEMKV LVSKEKDKDG KYSLMATVDK LELKGTSDKS NGSGTLEGEK<br>SDKSKAKLTI SEDLSKTTFE IFKEDGKTLV SKKVNSKDKS SIEEKFNAKG ELSEKTILRA NGTRLEYTEI KSDGTGKAKE<br>VLKDFALEGT LAADKTTLKV TEGTVVLSKH IPNSGEITVE LNDSNSTQAT KKTGKWDSNT STLTISVNSK KTKNIVFTKE<br>DTITVQKYDS AGTNLEGNAV EIKTLDELKN ALK | 86 |
| Exemplary OspA serotype 5 (strain CAA59727.1) | MKKYLLGIGL ILALIACKQN VSSLDEKNSV SVDLPGGMKV LVSKEKDKDG KYSLMATVEK LELKGTSDKN NGSGTLEGEK<br>TDKSKVKLTI AEDLSKTTFE IFKEDGKTLV SKKVTLKDKS STEEKFNEKG EISEKTIVRA NGTRLEYTDI KSDGSGKAKE<br>VLKDFTLEGT LAADGKTTLK VTEGTVVLSK NILKSGEITV ALDDSDTTQA TKKTGKWDSK TSTLTISVNS QKTKNLVFTK<br>EDTITVQKYD SAGTNLEGKA VEITTLEKLK DALK | 87 |
| Exemplary OspA serotype 6 (Strain CAA45010.1) | MKKYLLGIGL ILALIACKQN VSSLDEKNSV SVDLPGGMTV LVSKEKDKDG KYSLEATVDK LELKGTSDKN NGSGTLEGEK<br>TDKSKVKSTI ADDLSQTKFE IFKEDGKTLV SKKVTLKDKS STEEKFNGKG ETSEKTIVRA NGTRLEYTDI KSDGSGKAKE<br>VLKDFTLEGT LAADGKTTLK VTEGTVVLSK NILKSGEITA ALDDSDTTRA TKKTGKWDSK TSTLTISVNS QKTKNLVFTK<br>EDTITVQRYD SAGTNLEGKA VEITTLKELK NALK | 88 |
| Exemplary OspA serotype 7 (strain CAA56547.1) | MKKYLLGIGL ILALIACKQN VSSLDEKNSV SVDLPGEMKV LVSKEKDKDG KYSLEATVDK LELKGTSDKN NGSGVLEGVK<br>AAKSKAKLTI ADDLSQTKFE IFKEDGKTLV SKKVTLKDKS STEEKFNDKG KLSEKVVTRA NGTRLEYTEI QNDGSGKAKE<br>VLKSLTLEGT LTADGETKLT ENTITVQKYN TAGTKLEGSP AEIKDLEALK AALK | 89 |
| *H. pylori* ferritin with 8 amino acid bull frog sequence at N-terminus | ESQVRQQFSKDIEKLLNEQVNKEMQSSNLYMSMSSWSYTHSLDGAGLELFDHAAEEYEHAKKLIIFLNENNVPVQLTSISAPEHKFEGLTQ<br>IFQKAYEHEQHISESINNIVDHAIKCKDHATFNFLQWYVAEQHEEEVLFKDILDKIELIGNENHGLYLADQYVKGIAKSRKS | 90 |
| GS2 linker | GGGSGGGS | 91 |

TABLE 1-continued (Sequence Table): Description of the Sequences

| Description | Sequences | SEQ ID NO |
|---|---|---|
| GS5 linker | GGGSGGGSGGGSGGGSGGGS | 92 |
| Exemplary lumazine synthase | MQIYEGKLTAEGLRFGIVASRFNHALVDRLVEGAIDCIVRHGGREEDITLVRVPGSWEIPVAAGELARKEDIDAVIAIGVLIRGATPHFDY<br>IASEVSKGLANLSLELRKPITFGVITADTLEQATERAGTKHGNKGWEAALSAIEMANLFKSLR | 93 |
| Serotype 1<br>RD2 OspA | MDEKNSVSVDLPGEMKVLVSKEKNKDGKYDLIATVDKLELKGTSDKNNGSGVLEGVKADKSKVKLTISDDLGQTTLEVFKEDGKTLVSKKV<br>TSKDKSSTEEKENEKGEVSEKIITRADGTRLEYTGIKSDGSGKAKEVLKG*YTLEGQLSD*EKTTLVVKEGTVTLSKNISKSGEVSVELNDTD<br>SSAATKKTAAWNSGTSTLTITVNSKKTKDLVFTKENTITVQQYDSNGTKLEGSAVEITKLDEIKNALK | 94 |
| Serotype 1<br>RD1 OspA | MDEKNSVSVDLPGEMKVLVSKEKNKDGKYDLIATVDKLELKGTSDKNNGSGVLEGVKADKSKVKLTISDDLGQTTLEVFKEDGKTLVSKKV<br>TSKDKSSTEEKENEKGEVSEKIITRADGTRLEYTGIKSDGSGKAKEVLKG*YDLKGELSS*EKTTLVVKEGTVTLSKNISKSGEVSVELNDTD<br>SSAATKKTAAWNSGTSTLTITVNSKKTKDLVFTKENTITVQQYDSNGTKLEGSAVEITKLDEIKNALK | 95 |
| Serotype 1<br>OspA; LFA-1<br>replacement<br>Serotype 2 | MDEKNSVSVDLPGEMKVLVSKEKNKDGKYDLIATVDKLELKGTSDKNNGSGVLEGVKADKSKVKLTISDDLGQTTLEVFKEDGKTLVSKKV<br>TSKDKSSTEEKENEKGEVSEKIITRADGTRLEYTGIKSDGSGKAKEVLKG*FTLEGKVAN*EKTTLVVKEGTVTLSKNISKSGEVSVELNDTD<br>SSAATKKTAAWNSGTSTLTITVNSKKTKDLVFTKENTITVQQYDSNGTKLEGSAVEITKLDEIKNALK | 96 |
| Serotype 1<br>OspA; LFA-1<br>replacement<br>Serotype 3 | MDEKNSVSVDLPGEMKVLVSKEKNKDGKYDLIATVDKLELKGTSDKNNGSGVLEGVKADKSKVKLTISDDLGQTTLEVFKEDGKTLVSKKV<br>TSKDKSSTEEKENEKGEVSEKIITRADGTRLEYTGIKSDGSGKAKEVLKG*FALEGTLTD*EKTTLVVKEGTVTLSKNISKSGEVSVELNDTD<br>SSAATKKTAAWNSGTSTLTITVNSKKTKDLVFTKENTITVQQYDSNGTKLEGSAVEITKLDEIKNALK | 97 |
| Serotype 1<br>Non-glycosylated<br>LFA-1 replacement<br>RD2 OspA | MDEKNSVSVDLPGEMKVLVSKEKNKDGKYDLIATVDKLELKGTSDKNQGSGVLEGVKADKSKVKLTISDDLGQTTLEVEKEDGKTLVSKKV<br>TSKDKSSTEEKENEKGEVSEKIITRADGTRLEYTGIKSDGSGKAKEVLKG*YTLEGQLSD*EKTTLVVKEGTVTLSKQISKSGEVSVELQDTD<br>SSAATKKTAAWNSGTSTLTITVNSKKTKDLVETKENTITVQQYDSQGTKLEGSAVEITKLDEIKNALK | 98 |
| Non-glycosylated<br>OspA Serotype 1 with<br>LFA-1 site<br>replaced with Serotype 2 | MDEKNSVSVDLPGEMKVLVSKEKNKDGKYDLIATVDKLELKGTSDKNQGSGVLEGVKADKSKVKLTISDDLGQTTLEVFKEDGKTLVSKKV<br>TSKDKSSTEEKFNEKGEVSEKIITRADGTRLEYTGIKSDGSGKAKEVLKG*FTLEGKVAN*EKTTLVVKEGTVTLSKQTSKSGEVSVELQDTD<br>SSAATKKTAAWNSGTSTLTITVNSKKTKDLVFTKENTITVQQYDSQGTKLEGSAVEITKLDEIKNALK | 99 |
| Non-glycosylated<br>OspA Serotype 1 with<br>LFA-1 site replaced with<br>Serotype 3 | MDEKNSVSVDLPGEMKVLVSKEKNKDGKYDLIATVDKLELKGTSDKNQGSGVLEGVKADKSKVKLTISDDLGQTTLEVFKEDGKTLVSKKV<br>TSKDKSSTEEKFNEKGEVSEKIITRADGTRLEYTGIKSDGSGKAKEVLKG*FALEGTLTD*EKTTLVVKEGTVTLSKQISKSGEVSVELQDTD<br>SSAATKKTAAWNSGTSTLTITVNSKKTKDLVFTKENTITVQQYDSQGTKLEGSAVEITKLDEIKNALK | 100 |
| Non-glycosylated | MDEKNSVSVDLPGEMKVLVSKEKNKDGKYDLIATVDKLELKGTSDKNQGSGVLEGVKADKSKVKLTISDDLGQTTLEVFKEDGKTLVSKKV | 101 |

TABLE 1-continued

| (Sequence Table): Description of the Sequences | | |
|---|---|---|
| Description | Sequences | SEQ ID NO |
| OspA Serotype 1 with LFA-1 site replaced with RD1 | TSKDKSSTEEKFNEKGEVSEKIITRADGTRLEYTGIKSDGSGKAKEVLKG*YDLKGELSS*EKTTLVVKEGTVTLSKQISKSGEVSVELQDTD<br>SSAATKKTAAWNSGTSTLTITVNSKKTKDLVFTKENTITVQQYDSQGTKLEGSAVEITKLDEIKNALK | |
| Modified Serotype 1 OspA (X = any amino acid; XXXXXXXXX is not SEQ ID NO: 77; Z = N or Q) | MDEKNSVSVDLPGEMKVLVSKEKNKDGKYDLIATVDKLELKGTSDKNZGSGVLEGVKADKSKVKLTISDDLGQTTLEVFKEDGKTLVSKKV<br>TSKDKSSTEEKFNEKGEVSEKIITRADGTRLEYTGIKSDGSGKAKEVLKGXXXXXXXXXEKTTLVVKEGTVTLSKZISKSGEVSVELZDTD<br>SSAATKKTAAWNSGTSTLTITVNSKKTKDLVFTKENTITVQQYDSZGTKLEGSAVEITKLDEIKNALK | 102 |
| | Not Used | 103-200 |
| | Key for SEQ ID NOs: 201-225:<br>N-terminal Signal peptide in human light chain ferritin is underlined<br>Cysteine of Cysteine-Thrombin-His linker is double underlined<br>Bullfrog sequence is Italicized and curvy underlined (if present) | |
| bfpFerritin-N19Q/C31S/S26C | ESQVRQQFSKDIEKLLNEQVNKEMQSSNLYMCMSSWSYTHSLDGAGLFLFDHAAEEYEHAKKLIIFLNENNVPVQLTSISAPEHKFEGLTQ<br>IFQKAYEHEQHISESINNIVDHAIKSKDHATFNFLQWYVAEQHEEEVLFKDILDKIELIGNENHGLYLADQYVKGIAKSRKS | 201 |
| bfpFerritin-N19Q/C31S/S72C | ESQVRQQFSKDIEKLLNEQVNKEMQSSNLYMCMSSWSYTHSLDGAGLFLFDHAAEEYEHAKKLIIFLNENNVPVQLTSISAPEHKFEGLTQ<br>IFQKAYEHEQHISESINNIVDHAIKSKDHATFNFLQWYVAEQHEEEVLFKDILDKIELIGNENHGLYLADQYVKGIAKSRKS | 202 |
| bfpFerritin-N19Q/C31S/A75C | ESQVRQQFSKDIEKLLNEQVNKEMQSSNLYMCMSSWSYTHSLDGAGLFLFDHAAEEYEHAKKLIIFLNENNVPVQLTSISAPEHKFEGLTQ<br>IFQKAYEHEQHISESINNIVDHAIKSKDHATFNFLQWYVAEQHEEEVLFKDILDKIELIGNENHGLYLADQYVKGIAKSRKS | 203 |
| bfpFerritin-N19Q/C31S/K79C | ESQVRQQFSKDIEKLLNEQVNKEMQSSNLYMCMSSWSYTHSLDGAGLFLFDHAAEEYEHAKKLIIFLNENNVPVQLTSISAPEHKFEGLTQ<br>IFQKAYEHEQHISESINNIVDHAIKSKDHATFNFLQWYVAEQHEEEVLFKDILDKIELIGNENHGLYLADQYVKGIAKSRKS | 204 |
| bfpFerritin-N19Q/C31S/S100C | ESQVRQQFSKDIEKLLNEQVNKEMQSSNLYMCMSSWSYTHSLDGAGLFLFDHAAEEYEHAKKLIIFLNENNVPVQLTSISAPEHKFEGLTQ<br>IFQKAYEHEQHISECINNIVDHAIKSKDHATFNFLQWYVAEQHEEEVLFKDILDKIELIGNENHGLYLADQYVKGIAKSRKS | 205 |
| bfpFerritin-N19Q/C31S/S111C | ESQVRQQFSKDIEKLLNEQVNKEMQSSNLYMCMSSWSYTHSLDGAGLFLFDHAAEEYEHAKKLIIFLNENNVPVQLTSISAPEHKFEGLTQ<br>IFQKAYEHEQHISESINNIVDHAIKCKDHATFNFLQWYVAEQHEEEVLFKDILDKIELIGNENHGLYLADQYVKGIAKSRKS | 206 |
| bfpFerritin-N19Q/C31S/E12C | ESQVRQQFSKDIEKLLNEQVNKEMQSSNLYMCMSSWSYTHSLDGAGLFLFDHAAEEYEHAKKLIIFLNENNVPVQLTSISAPEHKFEGLTQ<br>IFQKAYEHEQHISESINNIVDHAIKSKDHATFNFLQWYVAEQHEEEVLFKDILDKIELIGNENHGLYLADQYVKGIAKSRKS | 207 |
| Exemplary *H. pylori* Ferritin with bullfrog linker | ESQVRQQFSKDIEKLLNEQVNKEMQSSNLYMCMSSWSYTHSLDGAGLFLFDHAAEEYEHAKKLIIFLNENNVPVQLTSISAPEHKFEGLTQ<br>IFQKAYEHEQHISESINNIVDHAIKSKDHATFNFLQWYVAEQHEEEVLFKDILDKIELIGNENHGLYLADQYVKGIAKSRKS | 208 |

TABLE 1-continued (Sequence Table): Description of the Sequences

| Description | Sequences | SEQ ID NO |
|---|---|---|
| Exemplary wild-type H. pylori ferritin (GenBank Accession AAD06160.1) (without bullfrog linker or N-terminal Met) | LSKDIIKLLNEQVNKEMNSSNLYMSMSSWCYTHSLDGAGLFLFDHAAEEYEHAKKLIIFLNENNVPVQLTSISAPEHKFEGLTQIFQKAYE HEQHISESINNIVDHAIKSKDHATFNFLQWYVAEQHEEEVLFKDILDKIELIGNENHGLYLADQYVKGIAKSRKS | 209 |
| CpG (ISS-1018) | TGACTGTGAACGTTCGAGATGA | 210 |
| Trichoplusia ni heavy chain ferritin | TQCNVNPVQIPKDWITMHRSCRNSMRQQIQMEVGASLQYLAMGAHFSKDVVNRPGFAQLF FDAASEEREHAMKLIEYLLMRGELTNDVSSLLQVRPPTRSSWKGGVEALEHALSMESDVT KSIRNVIKACEDDSEFNDYHLVDYLTGDFLEEQYKGQRDLAGKASTLKKLMDRHEALGEF IFDKKLLGIDV | 211 |
| Trichoplusia ni light chain ferritin | ADTCYNDVALDCGITSNSLALPRCNAVYGEYGSHGNVATELQAYAKLHLERSYDYLLSAAYFNNYQTNRAGFSKLFKKLSDEAWSKTIDII KHVTKRGDKMNFDQHSTMKTERKNYTAENHELEALAKALDTQKELAERAPYIHREATRNSQHLHDPEIAQYLEEEFIEDHAEKIRTLAGHT SDLKKFITANNGHDLSLALYVFDEYLQKTV | 212 |
| Pyrococcus furiosus ferritin | MLSERMLKALNDQLNRELYSAYLYFAMAAYFEDLGLEGFANWMKAQAEEEIGHALRFYNY IYDRNGRVELDEIPKPPKEWESPLKAFEAAYEHEKFISKSIYELAALAEEKDYSTRAFL EWFINEQVEEEASVKKILDLKLFAKDSPQILFMLDKELSARAPKLPGLLMQGGE | 213 |
| human heavy chain ferritin | MTTASTSQVRQNYHQDSEAAINRQINLELYASYVYLSMSYYFDRDDVALKNFAKYFLHQSHEEREHAEKLMKLQNQRGGRIFLQDIKKPDC DDWESGLNAMECALHLEKNVQQSLLELHKLATDKNDPHLCDFIETHYLNEQVKAIKELGDHVTNLRKMGAPESGLAEYLFDKHTLGDSDQE S | 214 |
| human light chain ferritin (signal peptide underlined) | <u>MDSKGSSQKGSRLLLLVSNLLLPQGVLA</u>SSQIRQNYSTDVEAAVNSLVNLYLQASYTYLSLGFYFDRDDVALEGVSHFFRELAEEKREG YERLLKMQNORGGRALFQDIKKPAEDEWGKTPDAMKAAMALEKKLNQALLDLHALGSARTDPHLCDFLETHFLDEEVKLIKKMGDHLTNLH RLGGPEAGLGEYLFERLTLKHD | 215 |
| lumazine synthase from Aquifex aeolicus | MQIYEGKLTAEGLRFGIVASRFNHALVDRLVEGAIDCIVRHGGREEDITLVRVPGSWEIPVAAGELARKEDIDAVIAIGVLIRGATPHFDY IASEVSKGLANLSLELRKPITFGVITADTLEQATERAGTKHGNKGWEAALSAIEMANLFKSLR | 216 |
| bullfrog linker | ESQVRQQF | 217 |
| Cysteine-Thrombin-His Linker | CLVPRGSLEHHHHHH | 218 |
| E. coli 6,7-dimethyl-8-ribityllumazine synthase | MNIIEANVATPDARVAITIARFNNFINDSLLEGAIDALKRIGQVKDENITVVWPGAYELPLAAGALAKTGKYDAVIALGTVIRGGTAHFE YVAGGASNGLAHVAQDSEIPVAFGVLTTESIEQAIERAGTKAGNKGAEAALTALEMINVLKAIKA | 219 |
| 16 amino acid linker | GGGGSGGGGSGGGGSG | 220 |
| 28 amino acid linker | GGSGSGSNSSASSGASSGGASGGSGGSG | 221 |
| 46 amino acid linker | GGSGSASSGASASGSSNGSGSGSGSSNSSASSGASSGGASGGSGSGGSG | 222 |

TABLE 1-continued (Sequence Table): Description of the Sequences

| Description | Sequences | SEQ ID NO |
|---|---|---|
| FR1 | GGSGSASAEAAAKEAAAKAGGSGGSG | 223 |
| FR2 | GGSGSASAEAAAKEAAAKEAAAKASGGSGGSG | 224 |
| 47 amino acid linker comprising a C for conjugation | SGGGSGSASSGASASGSSCSGSGSGSSSASSGASSGGASGGGSGGSG | 225 |
| | Key for sequences 226-242<br>Leader Sequence-underlined<br>gL-*Italicized*<br>Linker-double underlined<br>gH-Bold<br>bfpFerr (ferritin)-wavy underline<br>FR-shaded gray<br>gp220-Italicized and bold<br>gp42-Italicized and underlined<br>*T. ni* ferritin heavy chain-double wavy underline<br>Foldon sequence: Italicized and wavy underline<br>Thrombin cleavage site: Italicized and dashed underline<br>6X His (SEQ ID NO: 442) Tag: Bold, italicized and curvy underline | |
| SIB 15007<br>gL/gH/gp42-His | MRAVGVFLAICLVTIFVLPTWGNWAYPCCHVTQLRAQHLLALENISDIYLVSNQTCDGFSLASLNSPKNGSNQLVISRCANGLNVVSFFIS<br>ILKRSSSALTGHLRELLTTLETLYGSFSVEDLFGANLNRYAWHRGGGGSGSASSGASASGSSNGSGSGSGSNSSASSGASSOGASGGSGGS<br>GAASLSEVKLHLDIEGHASHYTIPWTELMAKVPGLSPEALWREANVTEDLASMLNRYKLIYKTSGTLGIALAEPVDIPAVSEGSMQVDASK<br>VHPGVISGLNSPACMLSAPLEKQLFYYIGTMLPNTRPHSYVFYQLRAHLSYVALSINGDKFQYTGAMTSKFLMGTYKRVTEKGDEHVLSLV<br>FGKTKDLPDLRGPFSYPSLTSAQSGDYSLVIVTTFVHYANFHNYFVPNLKDMFSRAVTMTAASYARYVLQKLVLLEMKGGCREPELDTETL<br>TTMFEVSVAFFKVGHAVGETGNGCVDLRWLAKSFFELTVLKDIIGICYGATVKGMQSYGLERLAAMLMATVKMEELGHLTTEKQEYALRLA<br>TVGYPKAGVYSGLIGGATSVLLSAYNRHPLFQPLHTVMRETLFIGSHVVLRELRLNVTTQGPNLALYQLLSTALCSALEIGEVLRGLALGT<br>ESGLFSPCYLSLRFDLTRDKLLSMAPQEATLDQAAVSNAVDGFLGRLSLEREDRDAWHLPAYKCVDRLDKVLMIIPLINVTFIISSDREVR<br>GSALYEASTTYLSSSLFLSPVIMNKCSQGAVAGEPRQIPKIQNFTRTQKSCIFCGFALLSYDEKEGLETTTYITSQEVQNSILSSNYFDFD<br>NLHVHYLLLTTNGTVMEIAGLYEERASGGGSGSASSGASASGSSGSGSGSGSSSASSGLAYFLPPRVRGGGRVAAAAITWVPKPNVEVWPV<br>DPPPPVNFNKTAEQEYGDKEVKLPHWTPTLHTFQVPQNYTKANCTYCNTREYTFSYKGCCFYFTKKKHTWNGCFQACAELYPCTYFYGPTP<br>DILPVVTRNLNAIESLWVGVYRVGEGNWTSLDGGTFKVYQIFGSHCTYVSKFSTVPVSHHECSFLKPCLCVSQRSNSGSHHHHHH | 226 |
| SIB 15008<br>gH/gL/gp42 NP | MRAVGVFLAICLVTIFVLPTWGNWAYPCCHVTQLRAQHLLALENISDIYLVSNQTCDGFSLASLNSPKNGSNQLVISRCANGLNVVSFFIS<br>ILKRSSSALTGHLRELLTTLETLYGSFSVEDLFGANLNRYAWHRGGGGSGSASSGASASGSSNGSGSGSGSNSSASSGASSOGASGGSGGS<br>GAASLSEVKLHLDIEGHASHYTIPWTELMAKVPGLSPEALWREANVTEDLASMLNRYKLIYKTSGTLGIALAEPVDIPAVSEGSMQVDASK<br>VHPGVISGLNSPACMLSAPLEKQLFYYIGTMLPNTRPHSYVFYQLRAHLSYVALSINGDKFQYTGAMTSKFLMGTYKRVTEKGDEHVLSLV<br>FGKTKDLPDLRGPFSYPSLTSAQSGDYSLVIVTTFVHYANFHNYFVPNLKDMFSRAVTMTAASYARYVLQKLVLLEMKGGCREPELDTETL<br>TTMFEVSVAFFKVGHAVGETGNGCVDLRWLAKSFFELTVLKDIIGICYGATVKGMQSYGLERLAAMLMATVKMEELGHLTTEKQEYALRLA<br>TVGYPKAGVYSGLIGGATSVLLSAYNRHPLFQPLHTVMRETLFIGSHVVLRELRLNVTTQGPNLALYQLLSTALCSALEIGEVLRGLALGT<br>ESGLFSPCYLSLRFDLTRDKLLSMAPQEATLDQAAVSNAVDGFLGRLSLEREDRDAWHLPAYKCVDRLDKVLMIIPLINVTFIISSDREVR<br>GSALYEASTTYLSSSLFLSPVIMNKCSQGAVAGEPRQIPKIQNFTRTQKSCIFCGFALLSYDEKEGLETTTYITSQEVQNSILSSNYFDFD<br>NLHVHYLLLTTNGTVMEIAGLYEERASGGGSGSASSGASASGSSGSGSGSGSSSASSGLAYFLPPRVRGGGRVAAAAITWVPKPNVEVWPV<br>DPPPPVNFNKTAEQEYGDKEVKLPHWTPTLHTFQVPQNYTKANCTYCNTREYTFSYKGCCFYFTKKKHTWNGCFQACAELYPCTYFYGPTP | 227 |

TABLE 1-continued (Sequence Table): Description of the Sequences

| Description | Sequences | SEQ ID NO |
|---|---|---|
| | DILPVVTRNLNAIESLWVGVYRVGEGNWTSLDGGTFKVYQIFGSHCTYVSKFSTVPVSHHECSFLKPCLCVSQRSNSGGSASSGGASGASG SSGSGGSASSGGASSGGASGSASGGSGSGSSGGSASSGGASGSGSGSGSASGLFLEDHAAEEYEHAKKLIIFLNENNPVLTSISAPEHKFEGLTIFKAYEHEHISESIN EQVNKEMQSSNLYMSMSSWSYTHSLDGAGLFLFDHAAEHEEEVLFKDILDKIELIGNENHGLYLADYVKGIAKSRKS NIVDHAIKCKDHATNFLWYVAEHEEEVLFKDILDKIELIGNENHGLYLADYVKGIAKSRKS | |
| SIB 15009 gH/gL/gp42_NP_C12 | MRAVGVFLAICLVTIFVLPTWGNWAYPCCHVTQLRAQHLLALENISDIVLVSNQTCDGFSLASLNSPKNGSNQLVISRCANGLNVVSFFIS ILKRSSSALTGHLRELLTTLETLIYGSFSVEDLFGANLNRYAWHRGGGSGSASSGGASASGSNGSGSGSNSSASSGGASSGGASGSGGS GAASLSEVKLHLDIEGHASHYTIPWTELMAKVPGLSPEALWREANVTEDLASMLNRYKLIYKTSGTLGIALAEFVDIPAVSEGSMQVDASK VHPGVISGLNSPACMLSAPLEKQLFYYIGTMLPNTRPHSYVFYQLRAHLSYVALSINGDKFQYTGAMTSKFLMGTYKRVTEKGDEHVLSLV FGKTKDL TABLE 1-continued (Sequence Table): Description of the Sequences

| Description | Sequences | SEQ ID NO |
|---|---|---|
| | TVGYPKAGVVSGLIGGATSVLLSAYNRHPLFQPLHTVMRETLFIGSHVVLRELRLNVTTQGPNLALYQLLSTALCSALEIGEVLRGLALGT ESGLFSPCYLSLRFDLTRDKLLSMAPQEATLDQAAVSNAVDGFLGRLSLEREDRDAWHLPAYKCVDRLDKVLMIIPLINVTFIISSDREVR GSALYEASTTYLSSSLFLSPVIMNKCSQGAVAGEPRQIPKIQNFTRTQKSCIFCGFALLSYDEKEGLETTYIITSQEVQNSILSSNYFDFD NLHVHYLLLTTNGTVMEIAGLYEERRAGGGSGGSSASGGSGGSSASGGSSASGGSGSSASGGSSGSGGSGSLAYFLPRVRGGGRVAAAAITWVPKPNVEVWPV DPPPVNENKTAEQEYGDKEVKLPHWTPTLHTFQVPQNYTKANCTYCNTREYTESYKGCCFYFTKKKHTWNGCFQACAELYPCTYFYGPTP DILPVTRNLNAIESLWVGVYRVGEGNWTSLDDGGTEKVTQIEGSHCTYVSKESTVPVSHHECSFLKPCLCVSQSRSNSGGSGESQVRQQFSK | |
| | DIEKLLNEQVNKEMQSSNLYMSMSWSYTHSLDGAGLFLFDHAAREYEHAKKLIIFLNENNVPVLTSISAPEHKFEGLTIIFKAYEHEQ HISESINNIVDHAIKCKDHATFNFLQWYVAEHEEEVLFKDILDKIELIGNENHGLYLADQYVKGIAKSRKS | |
| SIB 15012 gH/gL/gp42_NP_C16 | MDSKGSSQKGSRLLLLLVVSNLLLPGVLANWAYPCCHVTQLRAQHLLALENISDIYLVSNQTCDAFSLASLNSPKQGSNQLVISRCANGL NVVSFFISILKRSSSALTGHLRELLTTLETLYGSFSVEDLFGAQLNRYAWHRGGGGSGASASGGSNGSGGSGSNSSASGGASSGGASGGSSASGGSSGG ASGGGSGGGGSGAASLSEVKLHLDIEGHASHYTIPWTELLAKVPGLSPEALWREANVTEDLASMLNRYKLIYKTSGTLIGIALAEPVDIPAVSEG SMQVDASKVHPGVISGLNSPACMLSAPLEKQLFYYIGTMLPNTRPHSVYFYQLRCHLSVALSINGDKFQYTGAMTSKFLMGTYKRVTEKG DEHVLSLVFGKTKDLPDLRGPFSYPSLTSAQSGEYSLIVITFFVHYANFHNYFVPNLKDMFSRAVTMTAASYARYVLQKLVLLEMKGGCRE PELETETLTTMFEVSVAFFKVGHAVGETGNGCVDLRWLAKSFFELTVLKDIIGICYGATVKGMQSYGLERLAAILMATVKMEELGHLTTEK QEYALRLATVGYPKAGVVSGLIGGATSVLLSAYNRHPLFQPLHTVMRETLFIGSHVVLRELRLNVTTQGPNLALYQLLSTALCSALEIGEV LRGLALGTESGLFSPCYLSLRFDLTRDKLLSIAPQEATLDQAAVSQAVDGFLGRLSLEREDRDAWHLPAYKCVDRLDKVLMIIPLINVTFI ISSDREVRGSALYEASTTYLSSSLFLSPVILNKCSQGAVAGEPRQIPKIQNFTRTQKSCIFCGFALLSYDEKEGLETTYIITSQEVQNSIL SSNYFDFDNLHVHYLLLTTNGTVMEIAGLYEERASGGGSGGSSASGGSGGSSASGGSGGSSASGGSGGSSASGGSGGSSASGGSSGSGGSQVRSL TAEQEYGDKEVKLPHWTPTLHTFQVPQNYTKANCTYCNTREYTESYKGCCFYFTKKKHTWQGCFQACAELYPCTYFYGPTPDILPVTRSL QAIESLWVGVYRVGEGNWTSLDGGTEKVTQIEGSHCTYVSKESTVPVSHHECSFLKPCLCVSQSRSNSGGSGASSGGSGASGSSKDIEKLLNEQVNKEMQSS SSASSGASSGASASGGSASSGGASGGASSGGSASSGGASSGGSASSGQVRSQQFSKDIEKLLNEQVNKEMQSS | 231 |
| | NLYMSMSWSYTHSLDGAGLFLFDHAAREYEHAKKLIIFLNENNVPVLTSISAPEHKFEGLTIIFKAYEHEQHISESINQIVDHAICK DHATFNFLQWYVAEHEEEVLFKDILDKIELIGQENHGLYLADQYVKGIAKSRKS | |
| SIB 15013 gH/gL_rigid_NP | MRAVGVFLAICLVITIFVLPTWGNWAYPCCHVTQLRAQHLLALENISDIYLVSNQTCDGESLASLNSPKQGSNQLVISRCANGLNVVSFFIS ILKRSFSVEDLFGANLNRYAWHRGGGGSGASASGGSGGSSNGSGGSGGSNSSASGGASSGGASGGSSASGGSGGSASGGSSGGASSGGS GAASLSEVKLHLDIEGHASHYTIPWTELMAKVPGLSPEALWREANVTEDLASMLNRYKLIYKTSGTLIGIALAEPVDIPAVSEGSMQVDASK VHPGVISGLNSPACMLSAPLEKQLFYYIGTMLPNTRPHSVYFYQLRAHLSVALSINGDKFQYTGAMTSKFLMGTYKRVTEKGDEHVLSLV FGKTKDLPDLRGPFSYPSLTSAQSGCDYSLIVTFVHYANFHNYFVPNLKDMFSAVTMTAASYARYVLQKLVLLEMKGGCREPELDTETL TTMFEVSVAFFKVGHAVGETGNGCVDLRWLAKSFFELTVLKDIIGICYGATVKGMQSYGLERLAAMLMATVKMEELGHLTEKQEYALRLA TVGYPKAGVVSGLIGGATSVLLSAYNRHPLFQPLHTVMRETLFIGSHVVLRELRLNVTTQGPNLALYQLLSTALCSALEIGEVLRGLAIGT ESGLFSPCYLSLRFDLTRDKLLSMAPQEATLDQAAVSNAVDGFLGRLSLEREDRDAWHLPAYKCVDRLDKVLMIIPLINVTFIISSDREVR GSALYEASTTYLSSSLFLSPVIMNKCSQGAVAGEPRQIPKIQNFTRTQKSCIFCGFALLSYDEKEGLETTYIITSQEVPEPEPEPEPEPEPEPEPEPESQVRQQFSKDIEKLIN NLHVHYLLLTTNGTVMEIAGLYEERASGEPEPEPEPEPEPEPEPEPEPEPEPEPEPEPEPEPEPEPEPEPEPEPEPEPEPEPESQVRQQFSKDIEKLLN | 232 |
| | EQVNKEMQSSNLYMSMSWSYTHSLDGAGLFLFDHAAREYEHAKKLIIFLNENNVPVLTSISAPEHKFEGLTQIFQKAYEHEQHISESIN NIVDHAICKDHATFNFLWYVAEHEEEVLFKDILDKIELIGNENHGLYLADYVKGIAKSRKS* | |
| 46 amino acid linker | GGSGSASSGASASGSSGSGGSGSASSGASASGSSGSGGSGSASSGASASGSSGSGGSGSASSG | 233 |
| 32 amino acid linker | SGGGGSGGSSASGGSGGSSASGGSGGSSASGGSSASSG | 234 |

TABLE 1-continued (Sequence Table): Description of the Sequences

| Description | Sequences | SEQ ID NO |
|---|---|---|
| 88 amino acid linker | GGSGSASGGSASASGSSGSGSGSGSSASGGSASSGGASGGSGSGSGSGGSASSGGASGGSASGSSGSGSGSGSSASGGSASSGGASGGSGSGSG | 235 |
| 44 amino acid linker | GGSGSASSGGASGGSASGSSGSGSGSGSSASGGSASSGGASGGSGSGSG | 236 |
| 12 amino acid rigid linker | EPEPEPEPEPGG | 237 |
| 48 amino acid rigid linker | SGEPEPEPEPEPEPEPEPEPEPEPEPEPEPEPEPEPEPEPEPEPEPEP | 238 |
| gp42 fusion segment | LAYFLPPRVRGGGRVAAAAITWVPKPNVEVWPVDPPPPVNENKTAEQEYGDKEVKLPHWTPTLHTFQVPQNYTKANCTYCNTREYTESYKGCCFYFTKKKHTWNGCFQACAELYPCTYFYGPTPDILPVVTRNLNAIESLMVGVYRVGEGSHCTYVSKESTVPVSHHECSFLKPCLCVSQRSNS | 239 |
| gp42 fusion segment 2 | AITWVPKPNVEVWPVDPPPPVNENKTAEQEYGDKEVKLPHWTPTLHTFQVPQNYTKANCTYCNTREYTESYKGCCFYFTKKKHTWQGCFQACAELYPCTYFYGPTPDILPVVTRSLQAIESLWVGVYRVGEGNWTSLDGGTEKVYQIEGSHCTYVSKESTVPVSHHECSFLKPCLCVSQRSNS | 240 |
| SIB 15014 gH/gL/gp42_NP_C17 | MDSKGSSQKGSRLLLLLVVSNLLLPQGVLANWAYPCCHVTQLRAQHLLALENISDIYLVSNQTCDAFSLASLNSPKQGSNQLVISRCANGLNVVSFFISILKRSSSALTGHLRELLTTLEFLYGSFSVEDLFGAQLNRYAWHRGGGSGASASGSGSASSGGSGSGGSGSSASSGGASGGASGGSGSGASSGGASSLSEVKLHLDIEGHASHYTIPWTELLAKVPGLSPEALWREANVTEDLASMLNRYKLIYKTSGTLGIALAEPVDIPAVSEGSMQVDASKVHPGVISGLNSPACMLSAPLEKQLFYIGTMLPNTRPHSYVFYQLRCHLSTVALSINGDKFQYTGAMTSKFLMGTYKRVTEKGDEHVLSLVFGKTKDLPDLRGPFSYPSLTSAQSGEYSLVIVTTFVHYANFHNYFVPNLKDMFSRAVTMTAASYARYVLQKLVLLEMKGGCREPELETETLLTMFEVSVAFFKVGHAVGETGNGCVDLRWLAKSFFELTVLKDIIGICYGATVKGMQSYGLERLAAILMATVKMEELIGHLTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSIAPQEATLDQAAVSQAVDGFLGRLSLEREDRDAWHLPAYKCVDRLDKVLMIPPLINVTFIISSDREVRGSALYEASTTYLSSSLFLSPVIMNKCSQGAVAGEPRQIPKIQNFTRTQKSCIFCGFALLSYDEKEGLETTYITSQEVQNSILSSNYFPDFDNLHVHYLLLTTNGTVMEIAGLYEERASGGGSGASASGSGSASASGGSGASASGGSGSSSASSGGSASSGSGASGGSGSSASSGGASGGSGSGSGSASSGSGAESSGGASSGGASGGSGSASSGGSGSGSGSGSGGSGSSGSGSGSSGSGGSGSGSSGSGSGAS TAEQEYGDKEVKLPHWTPTLHTFQVPQNYTKANCTYCNTREYTESYKGCCFYFTKKKHTWQGCFQACAELYPCTYFYGPTPDILPVVTRNLNAIESLWVGVYRVGEGNWTSLDGGTEKVYQIEGSHCTYVSKESTVPVSHHECSFLKPCLCVSQRSNSGGGSGASSGGSASGGSGSGSGSSASSGGASSGGASGGSASGSSGSGSGSGSSASSGGASSGGASGGSGSGSG NLYMSMSSWSYTHSLDGAGLFLFDHAAEEYEHAKKLIIFLNENNVPVQLTSISAPEHKFEGLTQIFQKAYEHEQHISESINQIVDHAICKDHATFNFLQMYVARQHEEEVLFKDJILDKIELIGQENHGLYLADDYVKGIAKSRKS | 241 |
| SIB 15015 gH/gL/gp42_NP_C18 | MDSKGSSQKGSRLLLLLVVSNLLLPQGVLANWAYPCCHVTQLRAQHLLALENISDIYLVSNQTCDAFSLASLNSPKQGSNQLVISRCANGLNVVSFFISILKRSSSALTGHLRELLTTLEFLYGSFSVEDLFGAQLNRYAWHRGGGSGASASGSGSASASGGSGASASGGSGSSSASSGGSASSGSGASGGSGSSASSGGASGGSGSGSGSASSGSGAESSGGAASLSEVKLHLDIEGHASHYTIPWTELLAKVPGLSPEALWREANVTEDLASMLNRYKLIYKTSGTLGIALAEPVDIPAVSEGSMQVDASKVHPGVISGLNSPACMLSAPLEKQLFYIGTMLPNTRPHSYVFYQLRCHLSTVALSINGDKFQYTGAMTSKFLMGTYKRVTEKGDEHVLSLVFGKTKDLPDLRGPFSYPSLTSAQSGEYSLVIVTTFVHYANFHNYFVPNLKDMFSRAVTMTAASYARYVLQKLVLLEMKGGCREPELETETLLTMFEVSVAFFKVGHAVGETGNGCVDLRWLAKSFFELTVLKDIIGICYGATVKGMQSYGLERLAAMLMATVKMEELIGHLTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIPPLINVTFIISSDREVRGSALYEASTTYLSSSLFLSPVIMNKCSQGAVAGEPRQIPKIQNFTRTQKSCIFCGFALLSYDEKEGLETTYITSQEVQNSILSSNYFPDFDNLHVHYLLLTTNGTVMEIAGLYEERASGGGSGASASGSGSASASGGSGASASGGSGSSSASSGGSASSGSGASGGSGSSASSGGASGGSGSGSGSASSGSGAESSGGASSGGASGGSGSASSGGSGSGSGSGSGGSGSSGSGSGSSGSGGSGSGSSGSGSGAS TAEQEYGDKEVKLPHWTPTLHTFQVPQNYTKANCTYCNTREYTESYKGCCFYFTKKKHTWQGCFQACAELYPCTYFYGPTPDILPVVTRNLNAIESLWVGVYRVGEGNWTSLDGGTEKVYQIEGSHCTYVSKESTVPVSHHECSFLKPCLCVSQRSNSGGGSGASSGGSASGGSGSGSGSSASSGGASSGGASGGSASGSSGSGSGSGSSASSGGASSGGASGGSGSGSG | 242 |

TABLE 1-continued

| (Sequence Table): Description of the Sequences | | |
|---|---|---|
| Description | Sequences | SEQ ID NO |
| | NLYMSMSSWSYTHSLDGAGLFLFDHAAEEYEHAKKLIIFLNENNVPVQLTSISAPEHKFEGLTQIFQKAYEHEQHISESINQIVDHAIKCK<br>DHATENFLQWYVAEQHEEEVLEKDILDKIELIGQENHGLYLADQYVKGIAKSRKS | |
| | Not Used | 243-300 |
| | Key for SEQ ID NOs: 301-344:<br>leader sequences are underlined<br>HA-Bold<br>TEV-wavy underline and bold<br>Linker-double underlined<br>pFerr sequence-wavy underline<br>*Cys for conjugation is boxed, bold, italicized and wavy underline<br>F of Y98F mutation is bold, underlined and italicized<br>PQRET (SEQ ID NO: 532) (monobasic mutation) for H5 nanoparticles- italicized<br>Bullfrog sequence is italicized and curvy underlined (if present) | |
| SIB 6001: HA<br>(NC99 Y98F)<br>pFerr N19Q/C31S/S111C | MKAKLLVLLCTFATAYADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYV<br>NNKEKEVLVLWGVHHPPNIGNQRALYHTENAYVSVVSSHYSRRFTPEIAKRPKVRDQEGRINYYWTLLEPGDTIIFEANGNLIAPWYAFAL<br>SRGFGSGIITSNAPMDECDAKCQTPQGAINSSLPFQNVHPVTIGECPKYVRSAKLRMVTGLRNIPQRETRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD<br>SNVKNLYEKVKSQLKNNAKEIGNGCFEFYHKCNNECMESVKNGTYDYPKYSEESKLNREKIDSGGDIIKLLNEQVNKEMQSSNLYMSMSSW<br>SYTHSLDGAGLFLFDHAAEEYEHAKKLIIFLNENNVPVLTSISAPEHKFEGLTIFKAYEHEHISESINNIVDHAIKCKDHATENFLQ<br>WYVAEHEEEVLFKDILDKIELIGNENHGLYLADYVKGIAKSRKSGS | 301 |
| SIB 6243: HA<br>(NC99 Y98F)<br>bfpFerr N19Q/C31S/S111C | MKAKLLVLLCTFATAYADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYV<br>NNKEKEVLVLWGVHHPPNIGNQRALYHTENAYVSVVSSHYSRRFTPEIAKRPKVRDQEGRINYYWTLLEPGDTIIFEANGNLIAPWYAFAL<br>SRGFGSGIITSNAPMDECDAKCQTPQGAINSSLPFQNVHPVTIGECPKYVRSAKLRMVTGLRNIPQRETRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD<br>SNVKNLYEKVKSQLKNNAKEIGNGCFEFYHKCNNECMESVKNGTYDYPKYSEESKLNREKIDGS*ESQVRQQF*SKDIEKLLNEQVNKEMQSS<br>NLYMSMSSWSYTHSLDGAGLFLFDHAAEEYEHAKKLIIFLNENNVPVLTSISAPEHKFEGLTIFKAYEHEHISESINNIVDHAIKCK<br>DHATFNFLQWYVAEQHEEEVLFKDILDKIELIGNENHGLYLADYVKGIAKSRKS | 302 |
| SIB 6244: HA<br>(NC99 Y98F)<br>bfpFerr N19Q/C31S | MKAKLLVLLCTFATAYADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYV<br>NNKEKEVLVLWGVHHPPNIGNQRALYHTENAYVSVVSSHYSRRFTPEIAKRPKVRDQEGRINYYWTLLEPGDTIIFEANGNLIAPWYAFAL<br>SRGFGSGIITSNAPMDECDAKCQTPQGAINSSLPFQNVHPVTIGECPKYVRSAKLRMVTGLRNIPQRETRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD | 303 |

TABLE 1-continued (Sequence Table): Description of the Sequences

| Description | Sequences | SEQ ID NO |
| --- | --- | --- |
| | SNVKNLYEKVKSQLKNNAKEIGNGCFEFYHKCNNECMESVKNGTYDYPKYSEESKLNREKIDGSESQVRQQFSKDIEKLLNEQVNKEMQSS<br>NLYMSMSSWSYTHSLDGAGLELFDHAAEEYEHAKKLIIFLNENNVPVQLTSISAPEHKFEGLTQIFQKAYEHEQHISESINNIVDHAIKSK<br>DHATFNFLQWYVAEQHEEEVLFKDILDKIELIGNENHGLYLADQYVKGIAKSRKS | |
| SIB 6245: HA<br>(NC99 Y98F)<br>bfpFerr N19Q/C31S/E12C | MKAKLLVLLCTFTATYADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYV<br>NNKEKEVLVLWGVHHPPNIGNQRALYHTENAYVSVVSSHYSRRFTPEIAKRPKVRDQEGRINYYWTLLEPGDTIIFEANGNLIAPWYAFAL<br>SRGFGSGIITSNAPMDECDAKCQTPQGAINSSLPFQNVHPVTIGECPKYVRSAKLRMVTGLRNIPQRETRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD<br>SNVKNLYEKVKSQLKNNAKEIGNGCFEFYHKCNNECMESVKNGTYDYPKYSEESKLNREKIDGSESQVRQQFSKDIEKLLNCQVNKEMQSS<br>NLYMSMSSWSYTHSLDGAGLFLFDHAAEEYEHAKKLIIFLNENNVPVLTSISAPEHKFEGLTQIFQKAYEHEHISESINNIVDHAIKSK<br>DHATFNFLQWYVAEQHEEEVLFKDILDKIELIGNENHGLYLADYVKGIAKSRKS | 304 |
| SIB 6246: HA<br>(NC99 Y98F)<br>bfpFerr N19Q/C31S/S26C | MKAKLLVLLCTFTATYADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYV<br>NNKEKEVLVLWGVHHPPNIGNQRALYHTENAYVSVVSSHYSRRFTPEIAKRPKVRDQEGRINYYWTLLEPGDTIIFEANGNLIAPWYAFAL<br>SRGFGSGIITSNAPMDECDAKCQTPQGAINSSLPFQNVHPVTIGECPKYVRSAKLRMVTGLRNIPQRETRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD<br>SNVKNLYEKVKSQLKNNAKEIGNGCFEFYHKCNNECMESVKNGTYDYPKYSEESKLNREKIDGSESQVRQQFSKDIEKLLNEQVNKEMQSS<br>NLYMCMSSWSYTHSLDGAGLELFDHAAEEYEHAKKLIIFLNENNVPVQLTSISAPEHKFEGLTQIFUAYEHEQHISESINNIVDHAIKSK<br>DHATFNFLQWYVAEQHEEEVLFKDILDKIELIGNENHGLYLADQYVKGIAKSRKS | 305 |
| SIB 6247: HA<br>(NC99 Y98F)<br>bfpFerr N19Q/C31S/S72C | MKAKLLVLLCTFTATYADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYV<br>NNKEKEVLVLWGVHHPPNIGNQRALYHTENAYVSVVSSHYSRRFTPEIAKRPKVRDQEGRINYYWTLLEPGDTIIFEANGNLIAPWYAFAL<br>SRGFGSGIITSNAPMDECDAKCQTPQGAINSSLPFQNVHPVTIGECPKYVRSAKLRMVTGLRNIPQRETRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD<br>SNVKNLYEKVKSQLKNNAKEIGNGCFEFYHKCNNECMESVKNGTYDYPKYSEESKLNREKIDGSESQVRQQFSKDIEKLLNEQVNKEMQSS<br>NLYMSMSSWSYTHSLDGAGLELFDHAAEEYEHAKKLIIFLNENNVPVQLTCISAPEHKFEGLTQIFQKAYEHEQHISESINNIVDHAIKSK<br>DHATFNFLQWYVAEQHEEEVLFKDILDKIELIGNENHGLYLADYVKGIAKSRKS | 306 |
| SIB 6248: HA<br>(NC99 Y98F)<br>bfpFerr N19Q/C31S/A75C | MKAKLLVLLCTFTATYADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYV<br>NNKEKEVLVLWGVHHPPNIGNQRALYHTENAYVSVVSSHYSRRFTPEIAKRPKVRDQEGRINYYWTLLEPGDTIIFEANGNLIAPWYAFAL<br>SRGFGSGIITSNAPMDECDAKCQTPQGAINSSLPFQNVHPVTIGECPKYVRSAKLRMVTGLRNIPQRETRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD<br>SNVKNLYEKVKSQLKNNAKEIGNGCFEFYHKCNNECMESVKNGTYDYPKYSEESKLNREKIDGSESQVRQQFSKDIEKLLNEQVNKEMQSS | 307 |

TABLE 1-continued (Sequence Table): Description of the Sequences

| Description | Sequences | SEQ ID NO |
|---|---|---|
| | NLYMSMSSWSYTHSLDGAGLELFDHAAEEYEHAKKLIIFLNENNVPVQLTSISCPEHKFEGLTQIFQKAYEHEQHISESINNIVDHAIKSK<br>DHATFNFLQWYVAEQHEEEVLFKDILDKIELIGNENHGLYLADYVKGIAKSRKS | |
| SIB 6249: HA<br>(NC99 Y98F)<br>bfpFerr N19Q/C31S/S100C | MKAKLLVLLCTFTATYADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYV<br>NNKEKEVLVLWGVHHPPNIGNQRALYHTENAYVSVVSSHYSRRFTPEIAKRPKVRDQEGRINYYWTLLEPGDTIIFEANGNLIAPWYAFAL<br>SRGFGSGIITSNAPMDECDAKCQTPQGAINSSLPFQNVHPVTIGECPKYVRSAKLRMVTGLRNIPQRETRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD<br>SNVKNLYEKVKSQLKNNAKEIGNGCFEFYHKCNNECMESVKNGTYDYPKYSEESKLNREKIDGSESQVRQQFSKDIEKLLNEQVNKEMQSS<br>NLYMSMSSWSYTHSLDGAGLELFDHAAEEYEHAKKLIIFLNENNVPVQLTSISAPEHKFEGLTQIFQKAYEHEQHISECINNIVDHAIKSK<br>DHATFNFLQWYVAEQHEEEVLFKDILDKIELIGNENHGLYLADYVKGIAKSRKS | 308 |
| SIB 6250: HA<br>(NC99 Y98F)<br>bfpFerr N19Q/C31 STEV-S111C | MKAKLLVLLCTFTATYADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYV<br>NNKEKEVLVLWGVHHPPNIGNQRALYHTENAYVSVVSSHYSRRFTPEIAKRPKVRDQEGRINYYWTLLEPGDTIIFEANGNLIAPWYAFAL<br>SRGFGSGIITSNAPMDECDAKCQTPQGAINSSLPFQNVHPVTIGECPKYVRSAKLRMVTGLRNIPQRETRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD<br>SNVKNLYEKVKSQLKNNAKEIGNGCFEFYHKCNNECMESVKNGTYDYPKYSEESKLNREKIDENLYFQGSESQVRQQFSKDIEKLLNEQVN<br>KEMQSSNLYMSMSSWSYTHSLDGAGLELFDHAAEEYEHAKKLIIFLNENNVPVQLTSISAPEHKFEGLTQIFQKAYEHEQHISESINNIVD<br>HAIKCKDHATFNFLQWYVAEQHEEEVLFKDILDKIELIGNENHGLYLADQYVKGIAKSRKS | 309 |
| SIB 6252: HA<br>(NC99 Y98F)<br>bfpFerr N19Q/C31S TEV-S26C | MKAKLLVLLCTFTATYADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYV<br>NNKEKEVLVLWGVHHPPNIGNQRALYHTENAYVSVVSSHYSRRFTPEIAKRPKVRDQEGRINYYWTLLEPGDTIIFEANGNLIAPWYAFAL<br>SRGFGSGIITSNAPMDECDAKCQTPQGAINSSLPFQNVHPVTIGECPKYVRSAKLRMVTGLRNIPQRETRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD<br>SNVKNLYEKVKSQLKNNAKEIGNGCFEFYHKCNNECMESVKNGTYDYPKYSEESKLNREKIDENLYFQGSESQVRQQFSKDIEKLLNEQVN<br>KEMQSSNLYMCMSSWSYTHSLDGAGLELFDHAAEEYEHAKKLIIFLNENNVPVLTSISAPEHKFEGLTIFKAYEHEHISESINNIVD<br>HAIKSKDHATFNFLQWYVAEQHEEEVLFKDILDKIELIGNENHGLYLADYVKGIAKSRKS | 310 |
| SIB 6253: HA<br>(NC99 Y98F)<br>bfpFerr N19Q/C31S TEV-S72C | MKAKLLVLLCTFTATYADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYV<br>NNKEKEVLVLWGVHHPPNIGNQRALYHTENAYVSVVSSHYSRRFTPEIAKRPKVRDQEGRINYYWTLLEPGDTIIFEANGNLIAPWYAFAL<br>SRGFGSGIITSNAPMDECDAKCQTPQGAINSSLPFQNVHPVTIGECPKYVRSAKLRMVTGLRNIPQRETRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD<br>SNVKNLYEKVKSQLKNNAKEIGNGCFEFYHKCNNECMESVKNGTYDYPKYSEESKLNREKIDENLYFQGSESQVRQQFSKDIEKLLNEQVN | 311 |

TABLE 1-continued

| (Sequence Table): Description of the Sequences | | |
|---|---|---|
| Description | Sequences | SEQ ID NO |
| | KEMQSSNLYMSMSSWSYTHSLDGAGLFLFDHAAEEYEHAKKLIIFLNENNVPVQLTCISAPEHKFEGLTQIFQKAYEHEQHISESINNIVD<br>HAIKSKDHATFNFLQWYVAEQHEEEVLFKDILDKIELIGNENHGLYLADYVKGIAKSRKS | |
| SIB 6254: HA<br>(NC99 Y98F)<br>bfpFerr N19Q/C31S TEV-A75C | MKAKLLVLLCTFTATYADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYV<br>NNKEKEVLVLWGVHHPPNIGNQRALYHTENAYVSVVSSHYSRRFTPEIAKRPKVRDQEGRINYYWTLLEPGDTIIFEANGNLIAPWYAFAL<br>SRGFGSGIITSNAPMDECDAKCQTPQGAINSSLPFQNVHPVTIGECPKYVRSAKLRMVTGLRNIPQRETRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD<br>SNVKNLYEKVKSQLKNNAKEIGNGCFEFYHKCNNECMESVKNGTYDYPKYSEESKLNREKIDENLYFQGSESQVRQQFSKDIEKLLNEQVN<br>KEMQSSNLYMSMSSWSYTHSLDGAGLFLFDHAAEEYEHAKKLIIFLNENNVPVQLTSISCPEHKFEGLTQIFQKAYEHEQHISESINNIVD<br>HAIKSKDHATFNFLQWYVAEQHEEEVLFKDILDKIELIGNENHGLYLADYVKGIAKSRKS | 312 |
| SIB 6255: HA<br>(NC99-Y98F)<br>TEV bfpFerr-N19Q/C31S/S100C | MKAKLLVLLCTFTATYADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYV<br>NNKEKEVLVLWGVHHPPNIGNQRALYHTENAYVSVVSSHYSRRFTPEIAKRPKVRDQEGRINYYWTLLEPGDTIIFEANGNLIAPWYAFAL<br>SRGFGSGIITSNAPMDECDAKCQTPQGAINSSLPFQNVHPVTIGECPKYVRSAKLRMVTGLRNIPQRETRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD<br>SNVKNLYEKVKSQLKNNAKEIGNGCFEFYHKCNNECMESVKNGTYDYPKYSEESKLNREKIDENLYFQGSESQVRQQFSKDIEKLLNEQVN<br>KEMQSSNLYMSMSSWSYTHSLDGAGLFLFDHAAEEYEHAKKLIIFLNENNVPVQLTSISAPEHKFEGLTQIFQKAYEHEQHISECINNIVD<br>HAIKSKDHATFNFLQWYVAEQHEEEVLFKDILDKIELIGNENHGLYLADQYVKGIAKSRKS | 313 |
| SIB9063: HA<br>(South Carolina 1918, Y98F)<br>bfpFerr N19Q/C31S/S111C | MEARLLVLLCAFAATNADTICIGYHANNSTDTVDTVLEKNVTVTHSVNLLEDSHNGKLCKLKGIAPLQLGKCNIAGWLLGNPECDLLLTAS<br>SWSYIVETSNSENGTCFPGDFIDYEELREQLSSVSSFEKFEIFPKTSSWPNHETTKGVTAACSYAGASSFYRNLLWLTKKGSSYPKLSKSY<br>VNNKGKEVLVLWGVHHPPTGTDQQSLYQNADAYVSVGSSKYNRRFTPEIAARPKVRDQAGRMNYYWTLLEPGDTITFEATGNLIAPWYAFA<br>LNRGSGSGIITSDAPVHDCNTKCQTPHGAINSSLPFQNIHPVTIGECPKYVRSTKLRMATGLRNIPSIQSRGLFGAIAGFIEGGWTGMIDG<br>WYGYHHQNEQGSGYAADQKSTQNAIDGITNKVNSVIEKMNTQFTAVGKEFNNLERRIENLNKKVDDGFLDIWTYNAELLVLLENERTLDFH<br>DSNVRNLYEKVKSQLKNNAKEIGNGCFEFYHKCDDACMESVRNGTYDYPKYSEESKLNREEIDSGGESQVRQQFSKDIEKLLNEQVNKEMQ<br>SSNLYMSMSSWSYTHSLDGAGLFLFDHAAEEYEHAKKLIIFLNENNVPVQLTSISAPEHKFEGLTQIFQKAYEHEQHISESINNIVDHAIK<br>CKDHATFNFLQWYVAEQHEEEVLFKDILDKIELIGNENHGLYLADQYVKGIAKSRKS | 314 |
| SIB9065: HA<br>(California 2009, Y98F)<br>bfpFerr N19Q/C31S/S111C | MKAILVVLLYTFATANADTLCIGYHANNSTDTVDTVLEKNVTVTHSVNLLEDKHNGKLCKLRGVAPLHLGKCNIAGWILGNPECESLSTAS<br>SWSYIVETPSSDNGTCFPGDFIDYEELREQLSSVSSFERFEIFPKTSSWPNHDSNKGVTAACPHAGAKSFYKNLIWLVKKGNSYPKLSKSY<br>INDKGKEVLVLWGIHHPSTSADQQSLYQNADTYVFVGSSRYSKKFKPEIAIRPKVRDQEGRMNYYWTLVEPGDKITFEATGNLVVPRYAFA<br>MERNAGSGIIISDTPVHDCNTTCQTPKGAINTSLPFQNIHPITIGKCPKYVKSTKLRLATGLRNIPSIQSRGLFGAIAGFIEGGWTGMVDG<br>WYGYHHQNEQGSGYAADLKSTQNAIDEITNKVNSVIEKMNTQFTAVGKEFNHLEKRIENLNKKVDDGFLDIWTYNAELLVLLENERTLDYH<br>DSNVKNLYEKVRSQLKNNAKEIGNGCFEFYHKCDNTCMESVKNGTYDYPKYSEEAKLNREEIDSGGESQVRQQFSKDIEKLLNEQVNKEMQ | 315 |

TABLE 1-continued

| (Sequence Table): Description of the Sequences | | |
|---|---|---|
| Description | Sequences | SEQ ID NO |
| | SSNLYMSMSSWSYTHSLDGAGLFLFDHAAEEYEHAKKLIIFLNENNVPVQLTSISAPEHKFEGLTQIFQKAYEHEQHISESINNIVDHAIK<br>CKDHATFNFLQWYVAEQHEEEVLFKDILDKIELIGNENHGLYLADQYVKGIAKSRKS | |
| SIB9066: HA<br>(Malaysia 1954, Y98F)<br>bfpFerr N19Q/C31S/S111C | MKARLLILLCALSATDADTICIGYHANNSTDTVDTVLEKNVTVTHSVNLLEDSHNGKLCRLKGIAPLQLGKCNIAGWILGNPECESLLSNR<br>SWSYIAETPNSENGICFPGDFADYEELREQLSSVSSFERFEIFPKESSWPKHNITRGVTVACSHAKKSSFYKNLLWLTEANGLYPSLSKSY<br>VNDREKEVLVLWGVHHPSNIEDQRTLYRKENAYVSVVSSNYNRRFTPEIAERPKVRGQPGRMNYYWTLLEPGDKIIFEANGNLIAPWYAFA<br>LSRGPGSGIITSNASMDECDTKCQTPQGAINSSLPFQNIHPVTIGECPKYVRSTKLRMVTGLRNIPSIQSRGLFGAIAGFIEGGWTGMVDG<br>WYGYHHQNEQGSGYAADQKSTQNAINGITNKVNSVIEKMNTQFTAVGKEFNKLEKRMENLNKKVDDGFLDIWTYNAELLVLLENERTLDFH<br>DSNVKNLYEKVKNQLRNNAKEIGNGCFEFYHKCDNECMESVKNGTYDYPKYSEESKLNRAKIDSGGESQVRQQFSKDIEKLLNEQVNKEMQ<br>SSNLYMSMSSWSYTHSLDGAGLFLFDHAAEEYEHAKKLIIFLNENNVPVQLTSISAPEHKFEGLTQIFQKAYEHEQHISESINNIVDHAIK<br>CKDHATFNFLQWYVAEQHEEEVLFKDILDKIELIGNENHGLYLADQYVKGIAKSRKS | 316 |
| SIB9067: HA<br>(Fort Monmouth 1947, Y98F)<br>bfpFerr N19Q/C31S/S111C | MKAKLLILLCALTATDADTICIGYHANNSTDTVDTVLEKNVTVTHSVNLLEDSHNGKLCRLKGIAPLQLGKCNIAGWILGNPECESLLSKR<br>SWSYIAETPNSENGACFPGDFADYEELREQLSSVSSFERFEIFPKERSWPKHNITRGVTAACSHAGKSSFYKNLLWLTETDGSYPKLSKSY<br>VNNKEKEVLVLWGVHHPSNIEDQKTLYRKENAYVSVVSSNYNRRFTPEIAERPKVRGQAGRINYYWTLLEPGDTIIFEANGNLIAPWYAFA<br>LSRDFGSGIITSNASMDECDTKCQTPQGAINSSLPFQNIHPVTIGECPKYVKSTKLRMVTGLRNIPSIQSRGLFGAIAGFIEGGWTGMIDG<br>WYGYHHQNEQGSGYAADQKSTQNAINGITNKVNSVIEKMNTQFTAVGKEFNKLEKRMENLNKKVDDGFLDIWTYNAELLVLLENERTLDFH<br>DSNVKNLYEKVKNQLRNNAKEIGNGCFEFYHKCNNECMESVKNGTYDYPKYSEESKLNREKIDSGGESQVRQQFSKDIEKLLNEQVNKEMQ<br>SSNLYMSMSSWSYTHSLDGAGLFLFDHAAEEYEHAKKLIIFLNENNVPVQLTSISAPEHKFEGLTQIFQKAYEHEQHISESINNIVDHAIK<br>CKDHATFNFLQWYVAEQHEEEVLFKDILDKIELIGNENHGLYLADQYVKGIAKSRKS | 317 |
| SIB9068: HA<br>(Hong Kong 1977, Y98F)<br>bfpFerr N19Q/C31S/S111C | MKAKLLVLLCALSATDADTICIGYHANNSTDTVDTVLEKNVTVTHSVNLLEDSHNGKLCRLKGIAPLQLGKCSIAGWILGNPECESLFSKK<br>SWSYIAETPNSENGTCFPGYFADYEELREQLSSVSSFERFEIFPKERSWPKHNVTRGVTASCSHKGKSSFYRNLLWLTEKNGSYPNLSKSY<br>VNNKEKEVLVLWGVHHPSNIEDQKTIYRKENAYVSVVSSNYNRRFTPEIAERPKVRGQAGRINYYWTLLEPGDTIIFEANGNLIAPWYAFA<br>LSRGFGSGIITSNASMDECDTKCQTPQGAINSSLPFQNVHPVTIGECPKYVRSTKLRMVTGLRNIPSIQSRGLFGAIAGFIEGGWTGMIDG<br>WYGYHHQNEQGSGYAADQKSTQNAINGITNKVNSVIEKMNTQFTAVGKEFNKLEKRMENLNKKVDDGFLDIWTYNAELLVLLENERTLDFH<br>DSNVKNLYEKVKSQLKNNAKEIGNGCFEFYHKCNNECMESVKNGTYDYPKYSEESKLNREKIDSGGESQVRQQFSKDIEKLLNEQVNKEMQ<br>SSNLYMSMSSWSYTHSLDGAGLELFDHAAEEYEHAKKLIIFLNENNVPVQLTSISAPEHKFEGLTQIFQKAYEHEQHISESINNIVDHAIK<br>CKDHATFNFLQWYVAEQHEEEVLFKDILDKIELIGNENHGLYLADQYVKGIAKSRKS | 318 |
| SIB9070: HA<br>(H2, 1957, Y98F)<br>bfpFerr N19Q/C31S/S111C | MAIIYLILLFTAVRGDQICIGYHANNSTEKVDTILERNVTVTHAKDILEKTHNGKLCKLNGIPPLELGDCSIAGWLLGNPECDRLLSVPEW<br>SYIMEKENPRDGLCFPGSFNDYEELKHLLSSVKHFEKVKILPKDRWTQHTTTGGSRACAVSGNPSFFRNMVWLTKKESNYPVAKGSYNNTS<br>GEQMLIIWGVHHPNDETEQRTLYQNVGTYVSVGTSTLNKRSTPDIATRPKVNGLGSRMEFSWTLLDMWDTINFESTGNLIAPEYGFKISKR<br>GSSGIMKTEGTLENCETKCQTPLGAINTTLPFHNVHPLTIGECPKYVKSEKLVLATGLRNVPQIESRGLFGAIAGFIEGGWQGMVDGWYGY<br>HHSNDQGSGYAADKESTQKAFDGITNKVNSVIEKMNTQFEAVGKEFSNLERRLENLNKKMEDGFLDVWTYNAELLVLMENERTLDFHDSNV<br>KNLYDKVRMQLRDNVKELGNGCFEFYHKCDDECMNSVKNGTYDYPKYEEESKLNRNEIKSGGESQVRQQFSKDIEKLLNEQVNKEMQSSNL | 319 |

TABLE 1-continued (Sequence Table): Description of the Sequences

| Description | Sequences | SEQ ID NO |
|---|---|---|
| | YMSMSSWSYTHSLDGAGLFLFDHAAEEYEHAKKLIIFLNENNVPVQLTSISAPEHKFEGLTQIFQKAYEHEQHISESINNIVDHAIKCKDH<br>ATFNFLQWYVAEQHEEEVLEKDILDKIELIGNENHGLYLADQYVKGIAKSRKS | |
| SIB9072: HA<br>(H5N1, Indonesia 2005, Y98F,<br>monobasic) bfpFerr N19Q/C31S/S111C | MEKIVLLLAIVSLVKSDQICIGYHANNSTEQVDTIMEKNVTVTHAQDILEKTHNGKLCDLDGVKPLILRDCSVAGWLLGNPMCDEFINVPE<br>WSYIVEKANPTNDLCFPGSFNDYEELKHLLSRINHFEKIQIIPKSSWSDHEASSGVSSACPYLGSPSFFRNVVWLIKKNSTYPTIKKSYNN<br>TNQEDLLVLWGIHHPNDAAEQTRLYQNPTTYISIGTSTLNQRLVPKIATRSKVNGQSGRMEFFWTILKPNDAINFESNGNFIAPEYAYKIV<br>KKGDSAIMKSELEYGNCNTKCQTPMGAINSSMPFHNIHPLTIGECPKYVKSNRLVLATGLRNS*PQRETR*GLFGAIAGFIEGGWQGMVDGWY<br>GYHHSNEQGSGYAADKESTQKAIDGVTNKVNSIIDKMNTQFEAVGREFNNLERRIENLNKKMEDGFLDVWTYNAELLVLMENERTLDFHDS<br>NVKNLYDKVRLQLRDNAKELGNGCFEFYHKCDNECMESIRNGTYNYPQYSEEARLKREEISSGG*ESQVRQQF*SKDIEKLLNEQVNKEMQSS<br><br>NLYMSMSSWSYTHSLDGAGLFLFDHAAEEYEHAKKLIIFLNENNVPVQLTSISAPEHKFEGLTQIFQKAYEHEQHISESINNIVDHAIKCK<br>DHATFNFLQWYVAEQHEEEVLFKDILDKIELIGNENHGLYLADQYVKGIAKSRKS | 320 |
| SIB9097: HA<br>(Denver 1957, Y98F)<br>bfpFerr N19Q/C31S/S111C | MKAKLLILLCALSATDADTICIGYHANNSTDTVDTVLEKNVTVTHSVNLLEDSHNGKLCRLKGKAPLQLGNCNIAGWVLGNPECESLLSNR<br>SWSYIAETPNSENGTCFPGDFADYEELREQLSSVSSFERFEIFPKERSWPNHTTRGVTAACPHARKSSFYKNLVWLTEANGSYPNLSRSYV<br>NNQEKEVLVLWGVHHPSNIEEQRALYRKDNAYVSVVSSNYNRRFTPEIAKRPKVRDQSGRMNYYWTLLEPGDTIIFEATGNLIAPWYAFAL<br>SRGPGSGIITSNAPLDECDTKCQTPQGAINSSLPFQNIHPVTIGECPKYVRSTKLRMVTGLRNIPSVQSRGLFGAIAGFIEGGWTGMMDGW<br>YGYHHQNEQGSGYAADQKSTQNAINGITNKVNSVIEKMNTQFTAVGKEFNKLEKRMENLNKKVDDGFMDIWTYNAELLVLLENERTLDFHD<br>SNVKNLYEKVKNQLRNNAKELGNGCFEFYHKCDNECMESVKNGTYDYPKYSEESKLNREKIDSGG*ESQVRQQF*SKDIEKLLNEQVNKEMQS<br><br>SNLYMSMSSWSYTHSLDGAGLFLFDHAAEEYEHAKKLIIFLNENNVPVQLTSISAPEHKFEGLTQIFQKAYEHEQHISESINNIVDHAIKC<br>KDHATFNFLQWYVAEQHEEEVLFKDILDKIELIGNENHGLYLADQYVKGIAKSRKS | 321 |
| SIB9109: HA<br>(H3N8, Equine Ohio 2003, Y98F)<br>bfpFerr N19Q/C31S/S111C | MKTTIILILLTHWAYSQNPISGNNTATLCLGHHAVANGTLVKTISDDQIEVTNATELVQSISMGKICNNSYRILDGRNCTLIDAMLGDPHC<br>DAFQYENWDLFIERSSAFSNCFPYDIPDYASLRSIVASSGTLEFTAEGFTWTGVTQNGRSGACKRGSADSFFSRLNWLTKSGSSYPTLNVT<br>MPNNKNFDKLYIWGIHHPSSNQEQTKLYIQESGRVTVSTKRSQQTIIPNIGSRPWVRGQSGRISIYWTIVKPGDILMINSNGNLVAPRGYF<br>KLKTGKSSVMRSDVPIDICVSECITPNGSISNDKPFQNVNKVTYGKCPKYIRQNTLKLATGMRNVPEKQIRGIFGAIAGFIENGWEGMVDG<br>WYGFRYQNSEGTGQAADLKSTQAAIDQINGKLNRVIERTNEKFHQIEKEFSEVEGRIQDLEKYVEDTKIDLWSYNAELLVALENQHTIDLT<br>DAEMNKLFEKTRRQLRENAEDMGGGCFKIYHKCDNACIGSIRNGTYDHYIYRDEALNNRFKIDSGG*ESQVRQQF*SKDIEKLLNEQVNKEMQ<br><br>SSNLYMSMSSWSYTHSLDGAGLFLFDHAAEEYEHAKKLIIFLNENNVPVQLTSISAPEHKFEGLTQIFQKAYEHEQHISESINNIVDHAIK<br><br>CKDHATFNFLQWYVAEQHEEEVLFKDILDKIELIGNENHGLYLADQYVKGIAKSRKS | 322 |
| SIB9110: HA<br>(H3N8, Equine Bari 2005, Y98F)<br>bfpFerr N19Q/C31S/S111C | MKTTIIFIFILLTHWAYSQNPISDNNTATLCLGHHAVANGTLVKTISDDQIEVTNATELVQSISMGKICNNSYRILDGRNCTLIDAMLGDP<br>HCDVFQYENWDLFIERSSAFSNCFPYDIPDYASLRSIVASSGTLEFTAEGFTWTGVTQNGRSGACKRGSADSFFSRLNWLTKSGNSYPTLN<br>VTMPNNKNFDKLYIWGIHHPSSNQEQTKLYIQESGRVTVSTKRSQQTMIPNIGSRPWVRGQSGRISIYWTIVKPGDILMINSNGNLVAPRG<br>YFKLKTGKSSVMRSDVPIDICVSECITPNGSISNDKPFQNVNKVTYGKCPKYIRQNTLKLATGMRNVPEKQIRGIFGAIAGFIENGWEGMV<br>DGWYGFRYQNSEGTGQAADLKSTQAAIDQINGKLNRVIERTNEKFHQIEKEFSEVEGRIQDLEKYVEDTKIDLWSYNAELLVALENQHTID<br>LTDAEMNKLFEKTRRQLRENAEDMGGGCFKIYHKCDNACIGSIRNGTYDHYIYRDEALNNRFKIDSGG*ESQVRQQF*SKDIEKLLNEQVNKE | 323 |

TABLE 1-continued

| (Sequence Table): Description of the Sequences | | |
|---|---|---|
| Description | Sequences | SEQ ID NO |
| | MQSSNLYMSMSSWSYTHSLDGAGLFLFDHAAEEYEHAKKLIIFLNENNVPVQLTSISAPEHKFEGLTQIFQKAYEHEQHISESINNIVDHA<br>IKCKDHATFNFLQWYVAEQHEEEVLFKDILDKIELIGNENHGLYLADQYVKGIAKSRKS | |
| SIB9111: HA<br>(H3N8, Equine Aboyne 2003, Y98F)<br>bfpFerr N19Q/C31S/S111C | METTIILILLTHWVYSQNPISGNNTATLCLGHHAVANGTLVKTITDDQIEVTNATELVESISMGKICNNSYRVLDGRNCTLIDAMLGDPHC<br>DDFQYESWDLFIERSSASSNCFPYDIPDYASLRSIVASSGTLEFTAEGFTWTGVTQNGRSGACKRGSADSFFSRLNWLTKSGNSYPTLNVT<br>MPNNKNFDKLYIWGIHHPSSNKEQTKLYIQESGRVTVSTERSQQTVIPNIGSRPWVRGQSGRISIYWTIVKPGDVLMINSNGNLVAPRGYF<br>KLRTGKSSVMRSDALIDTCVSECITPNGSIPNDKPFQNVNKITYGRCPKYIRQNTLKLATGMRNVPEKQIRGIFGAIAGFIENGWEGMVDG<br>WYGFRYQNSEGTGQAADLKSTQAAIDQINGKLNRVIERTNEKFHQIEKEFSEVEGRIQDLEKYVEDTKIDLWSYNAELLVALENQHTIDLT<br>DAEMNKLFERTRRQLRENAEDMGGGCFKIYHKCDNACIGSIRNGTYDHYIYRDEALNNRFKIDSGGESQVRQQFSKDIEKLLNEQVNKEMQ<br>SSNLYMSMSSWSYTHSLDGAGLFLFDHAAEEYEHAKKLIIFLNENNVPVQLTSISAPEHKFEGLTQIFQKAYEHEQHISESINNIVDHAIK<br>CKDHATFNFLQWYVAEQHEEEVLFKDILDKIELIGNENHGLYLADQYVKGIAKSRKS | 324 |
| SIB9132: HA<br>(B, Massachusetts 2012, Y98F)<br>bfpFerr N19Q/C31S/S111C | MKAIIVLLMVVTSNADRICTGITSSNSPHVVKTATQGEVNVTGVIPLTTTPTKSYFANLKGTKTRGKLCPDCLNCTDLDVALGRPMCVGTT<br>PSAKASILHEVRPVTSGCFPIMHDRTKIRQLANLLRGYENIRLSTQNVIDAEKAPGGPYRLGTSGSCPNATSKSGFFATMAWAVPKDNNKN<br>ATNPLTVEVPYICAEGEDQITVWGFHSDNKTQMKNLYGDSNPQKFTSSANGVTTHYVSQIGGFPDQTEDGGLPQSGRIVVDYMMQKPGKTG<br>TIVYQRGVLLPQKVWCASGRSKVIKGSLPLIGEADCLHEKYGGLNKSKPYYTGEHAKAIGNCPIWVKTPLKLANGTKYRPPAKLLKERGFF<br>GAIAGFLEGGWEGMIAGWHGYTSHGAHGVAVAADLKSTQEAINKITKNLNSLSELEVKNLQRLSGAMDELHNEILELDEKVDDLRADTISS<br>QIELAVLLSNEGIINSEDEHLLALERKLKKMLGPSAVDIGNGCFETKHKCNQTCLDRIAAGTFNAGEFSLPTFDSLNITASGGESQVRQQF<br>SKDIEKLLNEQVNKEMQSSNLYMSMSSWSYTHSLDGAGLFLFDHAAEEYEHAKKLIIFLNENNVPVQLTSISAPEHKFEGLTQIFQKAYEH<br>EQHISESINNIVDHAIKCKDHATFNFLQWYVAEQHEEEVLFKDILDKIELIGNENHGLYLADQYVKGIAKSRKS | 325 |
| SIB9147: HA<br>(B, Phuket 2013)<br>bfpFerr N19Q/C31S/S111C | MKAIIVLLMVVTSNADRICTGITSSNSPHVVKTATQGEVNVTGVIPLTTTPTKSYFANLKGTRTRGKLCPDCLNCTDLDVALGRPMCVGTT<br>PSAKASILHEVRPVTSGCFPIMHDRTKIRQLPNLLRGYEKIRLSTQNVIDAEKAPGGPYRLGTSGSCPNATSKIGFFATMAWAVPKDNYKN<br>ATNPLTVEVPYICTEGEDQITVWGFHSDNKTQMKSLYGDSNPQKFTSSANGVTTHYVSQIGDFPDQTEDGGLPQSGRIVVDYMMQKPGKTG<br>TIVYQRGVLLPQKVWCASGRSKVIKGSLPLIGEADCLHEEYGGLNKSKPYYTGKHAKAIGNCPIWVKTPLKLANGTKYRPPAKLLKERGFF<br>GAIAGFLEGGWEGMIAGWHGYTSHGAHGVAVAADLKSTQEAINKITKNLNSLSELEVKNLQRLSGAMDELHNEILELDEKVDDLRADTISS<br>QIELAVLLSNEGIINSEDEHLLALERKLKKMLGPSAVDIGNGCFETKHKCNQTCLDRIAAGTFNAGEFSLPTFDSLNITAASSGGESQVRQ<br>QFSKDIEKLLNEQVNKEMQSSNLYMSMSSWSYTHSLDGAGLFLFDHAAEEYEHAKKLIIFLNENNVPVQLTSISAPEHKFEGLTQIFQKAY<br>EHEQHISESINNIVDHAIKCKDHATFNFLQWYVAEQHEEEVLFKDILDKIELIGNENHGLYLADQYVKGIAKSRKS | 326 |
| SIB9158: HA<br>(H1N1 COBRA-P1, Y98F)<br>bfpFerr N19Q/C31S/S111C | MKARLLVLLCALAATDADTICIGYHANNSTDTVDTVLEKNVTVTHSVNLLEDSHNGKLCKLKGIAPLQLGKCNIAGWLLGNPECESLLSAR<br>SWSYIVETPNSENGTCFPGDFIDYEELREQLSSVSSFERFEIFPKESSWPNHNTTKGVTAACSHAGKSSFYRNLLWLTKKGGSYPKLSKSY<br>VNNKGKEVLVLWGVHHPSTSTDQQSLYQNENAYVSVVSSNYNRRFTPEIAERPKVRGQAGRMNYYWTLLEPGDTIIFEATGNLIAPWYAFA<br>LSRGSGSGIITSNASMHECNTKCQTPQGAINSSLPFQNIHPVTIGECPKYVRSTKLRMVTGLRNIPSIQSRGLFGAIAGFIEGGWTGMIDG<br>WYGYHHQNEQGSGYAADQKSTQNAINGITNKVNSVIEKMNTQFTAVGKEFNNLEKRMENLNKKVDDGFLDIWTYNAELLVLLENERTLDFH<br>DSNVKNLYEKVKSQLRNNAKEIGNGCFEFYHKCDNECMESVKNGTYDYPKYSEESKLNREKIDSGGESQVRQQFSKDIEKLLNEQVNKEMQ | 327 |

TABLE 1-continued (Sequence Table): Description of the Sequences

| Description | Sequences | SEQ ID NO |
|---|---|---|
| | SSNLYMSMSSWSYTHSLDGAGLFLFDHAAEEYEHAKKLIIFLNENNVPVQLTSISAPEHKFEGLTQIFQKAYEHEQHISESINNIVDHAIK<br>CKDHATENFLQWYVAEQHEEEVLEKDILDKIELIGNENHGLYLADQYVKGIAKSRKS | |
| SIB9160: HA<br>(H1N1 COBRA-X3, Y98F)<br>bfpFerr N19Q/C31S/S111C | MEARLLVLLCAFAATNADTICIGYHANNSTDTVDTVLEKNVTVTHSVNLLEDSHNGKLCRLKGIAPLQLGNCSVAGWILGNPECESLFSKE<br>SWSYIAETPNPENGTCFPGYFADYEELREQLSSVSSFERFEIFPKESSWPNHTVTKGVTASCSHNGKSSFYRNLLWLTEKNGLYPNLSKSY<br>VNNKEKEVLVLWGVHHPSNIGDQRAIYHTENAYVSVVSSHYSRRFTPEIAKRPKVRDQEGRINYYWTLLEPGDTIIFEANGNLIAPWYAFA<br>LSRGFGSGIITSNASMDECDAKCQTPQGAINSSLPFQNVHPVTIGECPKYVRSTKLRMVTGLRNIPSIQSRGLFGAIAGFIEGGWTGMIDG<br>WYGYHHQNEQGSGYAADQKSTQNAINGITNKVNSVIEKMNTQFTAVGKEFNKLERRMENLNKKVDDGFLDIWTYNAELLVLLENERTLDFH<br>DSNVKNLYEKVKSQLKNNAKEIGNGCFEFYHKCNNECMESVKNGTYDYPKYSEESKLNREKIDSGGESQVRQQFSKDIEKLLNEQVNKEMQ<br>SSNLYMSMSSWSYTHSLDGAGLFLFDHAAEEYEHAKKLIIFLNENNVPVQLTSISAPEHKFEGLTQIFQKAYEHEQHISESINNIVDHAIK<br>CKDHATFNFLQWYVAEQHEEEVLFKDILDKIELIGNENHGLYLADQYVKGIAKSRKS | 328 |
| SIB9162: HA<br>(H1N1 COBRA-X6, Y98F)<br>bfpFerr N19Q/C31S/S111C | MEARLLVLLCAFAATNADTICIGYHANNSTDTVDTVLEKNVTVTHSVNLLEDSHNGKLCLLKGIAPLQLGNCSVAGWILGNPECELLISKE<br>SWSYIVETPNPENGTCFPGYFADYEELREQLSSVSSFERFEIFPKESSWPNHTVTGVSASCSHNGKSSFYRNLLWLTGKNGLYPNLSKSYA<br>NNKEKEVLVLWGVHHPPNIGDQRALYHTENAYVSVVSSHYSRKFTPEIAKRPKVRDQEGRINYYWTLLEPGDTIIFEANGNLIAPRYAFAL<br>SRGFGSGIITSNAPMDECDAKCQTPQGAINSSLPFQNVHPVTIGECPKYVRSAKLRMVTGLRNIPSIQSRGLFGAIAGFIEGGWTGMVDGW<br>YGYHHQNEQGSGYAADQKSTQNAINGITNKVNSVIEKMNTQFTAVGKEFNKLERRMENLNKKVDDGFLDIWTYNAELLVLLENERTLDFHD<br>SNVKNLYEKVKSQLKNNAKEIGNGCFEFYHKCNNECMESVKNGTYDYPKYSEESKLNREKIDSGGESQVRQQFSKDIEKLLNEQVNKEMQS<br>SNLYMSMSSWSYTHSLDGAGLFLFDHAAEEYEHAKKLIIFLNENNVPVQLTSISAPEHKFEGLTQIFQKAYEHEQHISESINNIVDHAIKC<br>KDHATFNFLQWYVAEQHEEEVLFKDILDKIELIGNENHGLYLADQYVKGIAKSRKS | 329 |
| SIB9164: HA<br>(H3N2, Perth 2009)<br>bfpFerr N19Q/C31S/S111C | MKTIIALSYILCLVFAQKLPGNDNSTATLCLGHHAVPNGTIVKTITNDQIEVTNATELVQSSSTGEICDSPHQILDGKNCTLIDALLGDPQ<br>CDGFQNKKWDLFVERSKAYSNCYPYDVPDYASLRSLVASSGTLEFNNESFNWTGVTQNGTSSACIRRSKNSFFSRLNWLTHLNFKYPALNV<br>TMPNNEQFDKLYIWGVHHPGTDKDQIFLYAQASGRITVSTKRSQQTVSPNIGSRPRVRNIPSRISIYWTIVKPGDILLINSTGNLIAPRGY<br>FKIRSGKSSIMRSDAPIGKCNSECITPNGSIPNDKPFQNVNRITYGACPRYVKQNTLKLATGMRNVPEKQTRGIFGAIAGFIENGWEGMVD<br>GWYGFRHQNSEGRGQAADLKSTQAAIDQINGKLNRLIGKTNEKFHQIEKEFSEVEGRIQDLEKYVEDTKIDLWSYNAELLVALENQHTIDL<br>TDSEMNKLFEKTKKQLRENAEDMGNGCFKIYHKCDNACIGSIRNGTYDHDVYRDEALNNRFQIKSGGESQVRQQFSKDIEKLLNEQVNKEM<br>QSSNLYMSMSSWSYTHSLDGAGLFLFDHAAEEYEHAKKLIIFLNENNVPVQLTSISAPEHKFEGLTQIFQKAYEHEQHISESINNIVDHAI<br>KCKDHATFNFLQWYVAEQHEEEVLFKDILDKIELIGNENHGLYLADQYVKGIAKSRKS | 330 |
| SIB9167: HA<br>(H3N2<br>Victoria 2011)<br>bfpFerr N19Q/C31S/S111C | MKTIIALSHILCLVFAQKLPGNDNSTATLCLGHHAVPNGTIVKTITNDQIEVTNATELVQNSSIGEICDSPHQILDGENCTLIDALLGDPQ<br>CDGFQNKKWDLFVERSKAYSNCYPYDVPDYASLRSLVASSGTLEFNNESFNWTGVTQNGTSSACIRRSNNSFFSRLNWLTQLNFKYPALNV<br>TMPNNEQFDKLYIWGVHHPVTDKDQIFLYAQSSGRITVSTKRSQQAVIPNIGYRPRIRNIPSRISIYWTIVKPGDILLINSTGNLIAPRGY<br>FKIRSGKSSIMRSDAPIGKCNSECITPNGSIPNDKPFQNVNRITYGACPRYVKQSTLKLATGMRNVPEKQTRGIFGAIAGFIENGWEGMVD<br>GWYGFRHQNSEGRGQAADLKSTQAAIDQINGKLNRLIGKTNEKFHQIEKEFSEVEGRIQDLEKYVEDTKIDLWSYNAELLVALENQHTIDL<br>TDSEMNKLFEKTKKQLRENAEDMGNGCFKIYHKCDNACIGSIRNGTYDHDVYRDEALNNRFQIKSGGESQVRQQFSKDIEKLLNEQVNKEM | 331 |

TABLE 1-continued (Sequence Table): Description of the Sequences

| Description | Sequences | SEQ ID NO |
|---|---|---|
| SIB9320: HA (H5N1, hCOBRA-2, Y98F, monobasic) bfpPerr N19Q/C31S/S111C | QSSNLYMSMSSWSYTHSLDGAGLFLFDHAAEEYEHAKKLIIFLNENNVPQLTSISAPEHKFEGLTQIFQKAYEHEQHISESINNIVDHAI CKDHATFNFLQWYVAEQHEEEVLFKDILDKIELIGNENHGLYLADQYVKGIAKSRKS | 332 |
| SIB9321: HA (H5N1, Bar Headed Goose 2005, Y98F, monobasic) bfpPerr N19Q/C31S/S111C | MEKIVLLLAIVSLVKSDQICIGYHANNSTEQVDTIMEKNVTVTHAQDILEKTHNGKLCDLDGVKPLIIRDCSVAGWLLGNPMCDEFINVPE WSYIVEKINPANDLCFPGNFNDYEELKHLLSRINHFEKIQIIPKSSWSDHEASSGVSSACPYQGRSSFFRNVVWLIKKNAYPTIKRSYNN TNQEDLLVLWGIHHPNDAAEQTRLYQNPTTYISVGTSTLNQRLVPKIATRSKVNGQSGRMEFFWTILKPNDAINFESNGNFIAPENAYKIV KKGDSTIMKSELEYGNCNTKCQTPIGAINSSMPFHNIHPLTIGECPKYVKSNRLVLATGLRNSPQIETRGLFGAIAGFIEGGWQGMVDGWY GYHHSNEQGSGYAADKESTQKAIDGVTNKVNSIIDKMNTQFEAVGREFNNLERRIENLNKKMEDGFLDVWTYNAELLVLMENERTLDFHDS NVKNLYDKVRLQLRDNAKELGNGCFEFYHRCDNECMESVRNGTYDYPQYSEEAARLKREEISSGGESQVRQQFSKDIEKLLNEQVNKEMQSS DHAITFNFLQWYVAEQHEEEVLFKDILDKIELIGNENHGLYLADQYVKGIAKSRKS | 333 |
| SIB9329: HA (H5N1, Whooper Swan 2005, Y98F, monobasic) bfpPerr N19Q/C31S/S111C | MEKIVLLLAIVSLVKSDQICIGYHANNSTEQVDTIMEKNVTVTHAQDILEKTHNGKLCDLDGVKPLIIRDCSVAGWLLGNPMCDEFINVPE WSYIVEKINPANDLCFPGNFNDYEELKHLLSRINHFEKIQIIPKSSWSDHEASSGVSSACPYQGRSSFFRNVVWLIKKDNAYPTIKRSYNN TNQEDLLVLWGIHHPNDAAEQTRLYQNPTTYISVGTSTLNQRLVPKIATRSKVNGQSGRMEFFWTILKPNDAINFESNGNFIAPENAYKIV KKGDSTIMKSELEYGNCNTKCQTPIGAINSSMPFHNIHPLTIGECPKYVKSNRLVLATGLRNSPQETRGLFGAIAGFIEGGWQGMVDGWY GYHHSNEQGSGYAADKESTQKAIDGVTNKVNSIIDKMNTQFEAVGREFNNLERRIENLNKKMEDGFLDVWTYNAELLVLMENERTLDFHDS NVKNLYDKVRLQLRDNAKELGNGCFEFYHRCDNECMESVRNGTYDYPQYSEEAARLKREEISSGGESQVRQQFSKDIEKLLNEQVNKEMQSS NLYMSMSSWSYTHSLDGAGLFLFDHAAEEYEHAKKLIIFLNENNVPQLTSISAPEHKFEGLTQIFQKAYEHEQHISESINNIVDHAICK DHATFNFLQWYVAEQHEEEVLFKDILDKIELIGNENHGLYLADQYVKGIAKSRKS | 334 |
| SIB9330: HA (H5N1, Mallard/Huadong 2003, Y98F, monobasic) bfpPerr N19Q/C31S/S111C | MEKIVLLLAIVSLVKSDQICIGYHANNSTEQVDTIMEKNVTVTHAQDILEKTHNGKLCDLDGVKPLIIRDCSVAGWLLGNPMCDEFINVPE WSYIVEKANPANDLCFPGNFNDYEELKHLLSRINHFEKIQIIPKSSWSDHEASSGVSSACPYQGRSSFFRNVVWLIKKNSTYPTIKRSYNN TNQEDLLVLWGIHHPNDAAEQTRLYQNPTTYISVGTPMGAINSSMPFHNIHPLTIGECPKYVKSNRLVLAPKIATRSKVNGQSGRMEFFWTILKPNDAINFESNGNFIAPEYAYKIV KKGDSAIMKSELEYGNCNTKCQTPMGAINSSMPFHNIHPLTIGECPKYVKSNRLVLATGLRNSPQRETRGLFGAIAGFIEGGWQGMVDGWY GYHHSNEQGSGYAADKESTQKAIDGVTNKVNSIIDKMNTQFEAVGREFNNLERRIENLNKKMEDGFLDVWTYNAELLVLMENERTLDFHDS NVKNLYDKVRLQLRDNAKELGNGCFEFYHRCDNECMESVRNGTYDYPQYSEEAARLKREEISSGGESQVRQQFSKDIEKLLNEQVNKEMQSS | 335 |

TABLE 1-continued (Sequence Table): Description of the Sequences

| Description | Sequences | SEQ ID NO |
|---|---|---|
| | NLYMSMSSWSYTHSLDGAGLFLFDHAAEEYEHAKKLIIFLNENNVPVQLTSISAPEHKFEGLTQIFQKAYEHEQHISESINNIVDHAIKCK<br>DHATFNFLQWYVAEQHEEEVLFKDILDKIELIGNENHGLYLADQYVKGIAKSRKS | |
| SIB9332: HA<br>(B, Brisbane 2008, D197N)<br>pFerr N19Q/C31S/S111C | MDTLLLWVLLLWVPGSTGDRICTGITSSNSPHVVKTATQGEVNVTGVIPLTTTPTKSHFANLKGTETRGKLCPKCLNCTDLDVALGRPKCT<br>GKIPSARVSILHEVRPVTSGCFPIMHDRTKIRQLPNLLRGYEHIRLSTHNVINAENAPGGPYKIGTSGSCPNITNGNGFFATMAWAVPKND<br>KNKTATNPLTIEVPYICTEGEDQITVWGFHSDNETQMAKLYGDSKPQKFTSSANGVTTHYVSQIGGFPNQTEDGGLPQSGRIVVDYMVQKS<br>GKTGTITYQRGILLPQKVWCASGRSKVIKGSLPLIGEADCLHEKYGGLNKSKPYYTGEHAKAIGNCPIWVKTPLKLANGTKYRPPAKLLKE<br>RGFFGAIAGFLEGGWEGMIAGWHGYTSHGAHGVAVAADLKSTQEAINKITKNLNSLSELEVKNLQRLSGAMDELHNEILELDEKVDDLRAD<br>TISSQIELAVLLSNEGIINSEDEHLLALERKLKKMLGPSAVEIGNGCFETKHKCNQTCLDRIAAGTFDAGEFSLPTFDSLNITAASSGRSS<br>GGDIIKLLNEQVNKEMQSSNLYMSMSSWSYTHSLDGAGLFLFDHAAEEYEHAKKLIIFLNENNVPVQLTSISAPEHKFEGLTQIFQKAYEH<br>EQHISESINNIVDHAIKCKDHATFNFLQWYVAEQHEEEVLFKDILDKIELIGNENHGLYLADQYVKGIAKSRKSGS | 336 |
| SIB9334: HA<br>(B, Phuket 2013)<br>pFerr N19Q/C31S/S111C | MKAIIVLLMVVTSNADRICTGITSSNSPHVVKTATQGEVNVTGVIPLTTTPTKSYFANLKGTRTRGKLCPDCLNCTDLDVALGRPMCVGTT<br>PSAKASILHEVRPVTSGCFPIMHDRTKIRQLPNLLRGYEKIRLSTQNVIDAEKAPGGPYRLGTSGSCPNATSKIGFFATMAWAVPKDNYKN<br>ATNPLTVEVPYICTEGEDQITVWGFHSDNKTQMKSLYGDSNPQKFTSSANGVTTHYVSQIGDFPDQTEDGGLPQSGRIVVDYMMQKPGKTG<br>TIVYQRGVLLPQKVWCASGRSKVIKGSLPLIGEADCLHEEYGGLNKSKPYYTGKHAKAIGNCPIWVKTPLKLANGTKYRPPAKLLKERGFF<br>GAIAGFLEGGWEGMIAGWHGYTSHGAHGVAVAADLKSTQEAINKITKNLNSLSELEVKNLQRLSGAMDELHNEILELDEKVDDLRADTISS<br>QIELAVLLSNEGIINSEDEHLLALERKLKKMLGPSAVDIGNGCFETKHKCNQTCLDRIAAGTFNAGEFSLPTFDSLNITAASSGGDIIKLL<br>NEQVNKEMQSSNLYMSMSSWSYTHSLDGAGLFLFDHAAEEYEHAKKLIIFLNENNVPVQLTSISAPEHKFEGLTQIFQKAYEHEQHISESI<br>NNIVDHAIKCKDHATFNFLQWYVAEQHEEEVLFKDILDKIELIGNENHGLYLADQYVKGIAKSRKSGS | 337 |
| SIB9337: HA<br>(B, Brisbane 2008, D197N)<br>pFerr N19Q/C31S/S111C | MKAIIVLLMVVTSNADRICTGITSSNSPHVVKTATQGEVNVTGVIPLTTTPTKSHFANLKGTETRGKLCPKCLNCTDLDVALGRPKCTGKI<br>PSARVSILHEVRPVTSGCFPIMHDRTKIRQLPNLLRGYEHIRLSTHNVINAENAPGGPYKIGTSGSCPNITNGNGFFATMAWAVPKNDKNK<br>TATNPLTIEVPYICTEGEDQITVWGFHSDNETQMAKLYGDSKPQKFTSSANGVTTHYVSQIGGFPNQTEDGGLPQSGRIVVDYMVQKSGKT<br>GTITYQRGILLPQKVWCASGRSKVIKGSLPLIGEADCLHEKYGGLNKSKPYYTGEHAKAIGNCPIWVKTPLKLANGTKYRPPAKLLKERGF<br>FGAIAGFLEGGWEGMIAGWHGYTSHGAHGVAVAADLKSTQEAINKITKNLNSLSELEVKNLQRLSGAMDELHNEILELDEKVDDLRADTIS<br>SQIELAVLLSNEGIINSEDEHLLALERKLKKMLGPSAVEIGNGCFETKHKCNQTCLDRIAAGTFDAGEFSLPTFDSLNITSGGDIIKLLNE<br>QVNKEMQSSNLYMSMSSWSYTHSLDGAGLFLFDHAAEEYEHAKKLIIFLNENNVPVQLTSISAPEHKFEGLTQIFQKAYEHEQHISESINN<br>IVDHAIKCKDHATFNFLQWYVAEQHEEEVLFKDILDKIELIGNENHGLYLADQYVKGIAKSRKS | 338 |
| SIB9347: HA<br>(B, Wisconsin 2010, Y98F)<br>pFerr N19Q/C31S/S111C | MKAIIVLLMVVTSNADRICTGITSSNSPHVVKTATQGEVNVTGVIPLTTTPTKSYFANLKGTRTRGKLCPDCLNCTDLDVALGRPMCVGTT<br>PSAKASILHEVRPVTSGCFPIMHDRTKIRQLPNLLRGYENIRLSTQNVIDAEKAPGGPYRLGTSGSCPNATSKIGFFATMAWAVPKDNYKN<br>ATNPLTVEVPYICTEGEDQITVWGFHSDNKTQMKSLYGDSNPQKFTSSANGVTTHYVSQIGDFPDQTEDGGLPQSGRIVVDYMMQKPGKTG<br>TIVYQRGVLLPQKVWCASGRSKVIKGSLPLIGEADCLHEKYGGLNKSKPYYTGEHAKAIGNCPIWVKTPLKLANGTKYRPPAKLLKERGFF<br>GAIAGFLEGGWEGMIAGWHGYTSHGAHGVAVAADIXSTQEAINKITENLNSLSELEVKNLQRLSGAMDELHNEILELDEKVDDLRADTISS<br>QIELAVLLSNEGIINSEDEHLLALERKLKKMLGPSAVDIGNGCFETKHKCNQTCLDRIAAGTFNAGEFSLPTFDSLNITASGGDIIKLLNE<br>QVNKEMQSSNLYMSMSSWSYTHSLDGAGLFLFDHAAEEYEHAKKLIIFLNENNVPVQLTSISAPEHKFEGLTQIFQKAYEHEQHISESINN<br>IVDHAIKCKDHATFNFLQWYVAEQHEEEVLFKDILDKIELIGNENHGLYLADQYVKGIAKSRKSGS | 339 |

TABLE 1-continued (Sequence Table): Description of the Sequences

| Description | Sequences | SEQ ID NO |
|---|---|---|
| SIB9379: (H3-Stem) bfpFerr N19Q/C31S/S111C | MKTIIALSYILCLVFAQKLPGNDNSTATLCLGHHAVPNGTIVKTITNDQIEVTNATELVFPGCGVIJKLATGMRNVPEKQTRGIFGAIAGFI ENGWIEGMVDGWYGERHQNSEGIGQAADLESTQAAINQINGMVNRVIELMEQGGPDCYLAELLVALLNQHVIDLTDSEMRKLFERTEKQLRE NAEDMGNGCFKIYHKCDNACIGSIRNGTYDHDVYR TABLE 1-continued (Sequence Table): Description of the Sequences Key for SEQ ID NOs: 401-445
Leader Sequence-underlined
gL-Italicized
Linker-double underlined
gH-Bold
bfpFerr (ferritin)-wavy underline
FR-shaded gray
gp220-Italicized and bold
gp42-Italicized and underlined
T. ni ferritin heavy chain-double wavy underline
Foldon sequence: Italicized and wavy underline
Thrombin cleavage site: Italicized and dashed underlined
6X His (SEQ ID NO: 442) Tag: Bold, italicized, and curvy underline

| Description | Sequences | SEQ ID NO |
|---|---|---|
| SIB 7187 leader sequence gp220 bfpFerr Nanoparticle N19Q/C31S/S111C | MDSKGSSQKGSRLLLLLVVSNLLLPQGVLAEAALLVCQYTIQSLIHLTGEDPGFFNVEIPEFFYPTCNVCTADVNVTINFDVGGKKHQLDL DFGQLTPHTKAVYQPRGAFGGSENATNLFLELLGAGELALTMRSKKLPINVTGEEEQVSLESVDVYFQDVFGTMWCHHAEMNPVYLIP ETVPYIKWDNCNSINITAVVRAQGLDVTLPLSLPTSAQDSNFSVKTEMLGNEIDIECIMEDGEISQVLPGDNKFNITCSGYESHVPSGGIL TSTSPVATPIPGTGTAYSLRLTPRPVSRFIGNNSILLYVFYSGNGPKASGGDYCIQSNIVFSDEIPASQDMPTNTTDITYGDNATYSVPMV TSEDANSPNVTVTAFWAWPNNTETDFKCKWTLTSGTPSGCENISGAFASNRTFDITVSGLIGTAPKTLIITRTATNATTTHKVIFSKAPEG SESQVRQFSKDIEKLLNEQVNKEMQSSNLYMSMSWSYTHSLDGAGLFLFDHAAEEYEHAKKLLIFLNENNVPVQLTSISAPEHKFEGLT QIFQKAYEHEQHISESINNIVDHAIKCKDHATFNFLQWYVAEQHEEVLFKDILDKIELIGNENHGLYLADQYVKGIAKSRKS | 401 |
| SIB 7340 leader sequence gL(D7)_linker_gH bfpFerr Nanoparticle N19Q/C31S/S111C | MRAVGVFLAICLVITIFVLPTWGNWAYPCCHVTQLRAQHLLALENISDIYLVSNQTCDGFSLASLNSPKNGSNQLVISRCANGLNVVSFFISI LKRSSSALTGHLRELITTLETLYGSFSVEDLFGANLNRGGSGSASSGASASGSNSGSGSGSNSASSGASSGGASGGSGGSGAASLSEV KLHLDIEGHASHYTIPWTELMAKVPGLSPEALWREANVTEDLASMLNRYKLIYKTSGTLGIALAEPVDIPAVSEGSMQYDASKVHPGVISG LNSPACMLSAPLEKQLFYYIGTMLPNTRPHSYVFYQLRCHLSYVALSINGDKFQYTGAMTSKFLMGTYKRVTEKGDEHVLSLVFGKTKDLP DLRGPFSYPSLTSAQSGDYSLVIVTTFVHYANFHNYFVPNLKDMESRAVTMTAASYARVVLQKIVLLLEMKGGCREPELDTETLITMFEVSV AFFKVGHAVEGTGNGCVDLRWLAKSFFELTVLKDIIGICYGATVKGMQSYGLERIAAMLMATVKMEEELGHLTTEKQEYALRLATVGYPKAG VYSGLIGGATSVLLSAYNRHPLFQPLHTVMREETLFIGSHVVLRELRLNVTTQGPNLALIYQLLSTALCSALEIGEVLRGLALGTESGLFSPC YLSLRFDLTRDKLLSMAPQEATLDQAAVSNAVDGFLGRLLSLEREERDAWHLPAYKCVDRLDKVLMIIPLINVTFIISSDREVRGSALYEAS TTYLSSSLELSPVIMNKCSQAVAGEPRQIPKIQNFTRTQKSCIFCGFALLSYDEKEGLETTYVITSQEVQNSILSSNYEDFDNLHVHYLL LTTNGTVMEIAGLYPERASGGSGGGSGGGSGGGSESQVRQFSKDIEKLLNEQVNKEMQSSNLYMSMSWSYTHSLDGAGLFLFDH AAEEYEHAKKLLIFLNENNVPVQLTSISAPEHKFEGLTQIFQKAYEHEQHISESINNIVDHAIKCKDHATFNFLQWYVAEQHEEVLFKDI LDKIELIGNENHGLYLADQYVKGIAKSRKS | 402 |
| SIB 7342 leader sequence gL(D7)_linker_gH bfpFerr Nanoparticle | METDLLLMWLLLMVPGSTGNWAYPCCHVTQLRAQHLLALENISDIYLVSNQTCDGFSLASLNSPKNGSNQLVISRCANGLNVVSFFISILK RSSSALTGHLRELITTLETLYGSFSVEDLFGANLNRGGSGSASSGASASGSNSGSGSGSNSASSGGSGAASLSEVKLHLDIEGHASHYTIPWTELMAKVPGLSPEA LWREANVTEDLASMLNRYKLIYKTSGTLGIALAEPVDIPAVSEGSMQVDASKVHPGVISGLNSPACMLSAPLEKQLFYYIGTMLPNTRPHS YVFYQLRCHLSYVALSINGDKFQYTGAMTSKFLMGTYKRVTEKGDEHVLSLVFGKTKDLPDLRGPFSYPSLTSAQSGDYSLVIVTTFVHYA | 403 |

TABLE 1-continued (Sequence Table): Description of the Sequences

| Description | Sequences | SEQ ID NO |
|---|---|---|
| N19Q/C31S/S111C | NFHNYFVPNLKDMFSRAVTMTAASYARYVLQKLVLLEMKGGCREPELDTETLTTMFEVSVAFFKVGHAVGETGNGCVDLRWLAKSFFELTV LKDIIGICYGATVKGMQSYGLERLAAMLMATVKMEELGHLTEKQEYALRLATVGYPKAGVYSGLIGGATSVLLSAYNRHPLFQPLHTVMR ETLFIGSHVVLRELRLNVTTQGPNLALYQLLSTALCSALEIGEVLRGLALGTESGLFSPCYLSPVIMNKCSQGAVAGEPRQIP VDGFLGRLSLEREDRDAWHLPAYKCVDRLDKVLMIIPLINVTFIISSDREVRGSALYEASTTYLSSSLELSPVIMNKCSQGAVAGEPRQIP KIQNFTRTQKSCIFCGFALLSYDEKEGLETTYITSQEVQNSILSSNYFDEDNLHVHYLLLTTNGTVMEIAGLYEERASGGGSGGGSGGGS GGGSGGGSESQVRQQFSKDIEKLLNEQVNKEMQSSNLYMSMSWSYTHSLDGAGLFLFDHAAEEYEHAKKLLIFLNENNVPQLTSISAPE HKFEGLTQLFQKAYEHEQHLSESINNIVDHAIKCKDHAATNFLQWVAEQHEEEVLFKDILDKIELLIGNENHGLYALADQVKGIAKSRKS | 404 |
| SIB 7379 leader sequence gL(D7)_linker_gH Trimer | MRAVGVFLAICLVIIFVLPTWGNWAYPCCHVTQLRAQHLLALENISDIYLVSNQTCDGFSLASLNSPKNGSNQLVISRCANGLNVVSFFIS ILKRSSSALTGHLRELLTTLETLYGSFSVEDLFGANLNRGGSGGSGASSGGSASSGGSGSGASSGGSGSGASSGGSGSGAASLSE VKLHLDIEGHASHYTIPWTELMAKVPGLSPEALWREANVTEDLASMLNRYKLIYKTSGTLGIALAEPVDIPAVSEGSMQVDASKVHPGVIS GLNSPACMLSAPLEKQLFYYIGTMLPNTRPHSVYFYQLRCHLSYVALSINGDKFQYTGAMTSKFLMGTYKRVTEKGDEHVLSLVFGKTKDL PDLRGPFSYPSLTSAQSGDYSLVIVTTFVHYANFHNYFVPNLKDMFSRAVTMTAASYARYVLQKIVLLEMKGGCREPELDTETLTTMFEVS VAFFKVGHAVGETGNGCVDLRWLAKSFFELTVLKDIIGICYGATVKGMQSYGLERLAAMLMATVKMEELGHLTEKQEYALRLATVGYPKA GVYSGLIGGATSVLLSAYNRHPLFQPLHTVMRETLFIGSHVVLRELRLNVTTQGPNLALYQLLSTALCSALEIGEVLRGLALGTESGLFSP CYLSLRFDLTRDKLLSMAPQEATLDQAAVSNAVDGFLGRLSLEREDRDAWHLPAYKCVDRLDKVLMIIPLINVTFIISSDREVRGSALYEA STTYLSSSLFLSPVIMNKCSQGAVAGEPRQIPKIQNFTRTQKSCIFCGFALLSYDEKEGLETTYITSQEVQNSILSSNYFDFDNLHVHYL LLTTNGTVMEIAGLYEERASGSGSYIPEAPRDGQAYVRKDGEWVLLSTFLGSGSGSGLVPRGSGAGGHHHHHH | 405 |
| SIB 7380 leader sequence gL(D7)_linker_gH Trimer | METDTLLLWLLLWVPGSTGNWAYPCCHVTQLRAQHLLALENISDIYLVSNQTCDGFSLASLNSPKNGSNQLVISRCANGLNVVSFFISIL KRSSSALTGHLRELLTTLETLYGSFSVEDLFGANLNRGGSGGSGGSGAASLSEVKLHLDIEGHASHYTIPWTELMAKVPGLSPE ALWREANVTEDLASMLNRYKLIYKTSGTLGIALAEPVDIPAVSEGSMQVDASKVHPGVISGLNSPACMLSAPLEKQLFYYIGTMLPNTRPH SYVFYQLRCHLSYVALSINGDKFQYTGAMTSKFLMGTYKRVTEKGDEHVLSLVFGKTKDLPDLRGPFSYPSLTSAQSGDYSLVIVTTFVHY ANFHNYFVPNLKDMFSRAVTMTAASYARYVLQKLVLLEMKGGCREPELDTETLTTMFEVSVAFFKVGHAVGETGNGCVDLRWLAKSFFELT VLKDIIGICYGATVKGMQSYGLERLAAMLMATVKMEELGHLTEKQEYALRLATVGYPKAGVYSGLIGGATSVLLSAYNRHPLFQPLHTVM RETLFIGSHVVLRELRLNVTTQGPNLALYQLLSTALCSALEIGEVLRGLALGTESGLFSPCYLSLRFDLTRDKLLSMAPQEATLDQAAVSN AVDGFLGRLSLEREDRDAWHLPAYKCVDRLDKVLMIIPLINVTFIISSDREVRGSALYEASTTYLSSSLFLSPVIMNKCSQGAVAGEPRQI PKIQNFTRTQKSCIFCGFALLSYDEKEGLETTYITSQEVQNSILSSNYFDFDNLHVHYLLLTTNGTVMEIAGLYEERASGSGSYIPEAPRD GQAYVRKDGEWVLLSTFLGSGSGSGLVPRGSGAGGHHHHHH | 406 |
| SIB 7381 leader sequence gL(D7)_linker_gH Monomer | MRAVGVFLAICLVIIFVLPTWGNWAYPCCHVTQLRAQHLLALENISDIYLVSNQTCDGFSLASLNSPKNGSNQLVISRCANGLNVVSFFIS ILKRSSSALTGHLRELLTTLETLYGSFSVEDLFGANLNRGGSGGSGASSGGSASSGGSGSGAASLSE VKLHLDIEGHASHYTIPWTELMAKVPGLSPEALWREANVTEDLASMLNRYKLIYKTSGTLGIALAEPVDIPAVSEGSMQVDASKVHPGVIS GLNSPACMLSAPLEKQLFYYIGTMLPNTRPHSVYFYQLRCHLSYVALSINGDKFQYTGAMTSKFLMGTYKRVTEKGDEHVLSLVFGKTKDL PDLRGPFSYPSLTSAQSGDYSLVIVTTFVHYANFHNYFVPNLKDMFSRAVTMTAASYARYVLQKIVLLEMKGGCREPELDTETLTTMFEVS VAFFKVGHAVGETGNGCVDLRWLAKSFFELTVLKDIIGICYGATVKGMQSYGLERLAAMLMATVKMEELGHLTEKQEYALRLATVGYPKA GVYSGLIGGATSVLLSAYNRHPLFQPLHTVMRETLFIGSHVVLRELRLNVTTQGPNLALYQLLSTALCSALEIGEVLRGLALGTESGLFSP CYLSLRFDLTRDKLLSMAPQEATLDQAAVSNAVDGFLGRLSLEREDRDAWHLPAYKCVDRLDKVLMIIPLINVTFIISSDREVRGSALYEA STTYLSSSLFLSPVIMNKCSQGAVAGEPRQIPKIQNFTRTQKSCIFCGFALLSYDEKEGLETTYITSQEVQNSILSSNYFDFDNLHVHYL LLTTNGTVMEIAGLYEERASGSGSGGLVPRGSGAGGHHHHHH | 406 |
| SIB 7382 leader sequence gL(D7)_linker_gH Monomer | METDTLLLWLLLWVPGSTGNWAYPCCHVTQLRAQHLLALENISDIYLVSNQTCDGFSLASLNSPKNGSNQLVISRCANGLNVVSFFISIL KRSSSALTGHLRELLTTLETLYGSFSVEDLFGANLNRGGSGGSGGSGAASLSEVKLHLDIEGHASHYTIPWTELMAKVPGLSPE ALWREANVTEDLASMLNRYKLIYKTSGTLGIALAEPVDIPAVSEGSMQVDASKVHPGVISGLNSPACMLSAPLEKQLFYYIGTMLPNTRPH SYVFYQLRCHLSYVALSINGDKFQYTGAMTSKFLMGTYKRVTEKGDEHVLSLVFGKTKDLPDLRGPFSYPSLTSAQSGDYSLVIVTTFVHY | 407 |

TABLE 1-continued (Sequence Table): Description of the Sequences

| Description | Sequences | SEQ ID NO |
|---|---|---|
| | ANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSGSGSGLVPRGSGAGGGHHHHHH | |
| SIB 7392<br>leader sequence<br>gL_linker_gH Monomer | MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSGSGSGLVPRGSGAGGGHHHHHH | 408 |
| SIB 7397<br>leader sequence<br>gL_linker_gH Monomer | MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSGSGSGLVPRGSGAGGGHHHHHH | 409 |
| SIB 7400<br>leader sequence<br>gL_linker_gH bfpFerr<br>Nanoparticle<br>N19Q/C31S/S111C | METDTLLLWVLLLWVPGSTGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGGSGGGGSGGGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGGGSGGGSGGGSGGGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS | 410 |
| SIB 7402 | MRAVGVFLAICLVTIFVLPTWGNWAYPCCHVTQLRAQHLLALENISDIYLVSNQTCDGESLASLNSPKNGSNQLVISRCANGLNVVSFFIS | 411 |

TABLE 1-continued (Sequence Table): Description of the Sequences

| Description | Sequences | SEQ ID NO |
|---|---|---|
| leader sequence<br>gL_linker_gH_trimer | ILKRSSSALTGHLRELLTTLETLYGSFSVEDLFGANLNRYAWHRGGGGSGSGSNSSASSGASSGGASGGSGGSGAASLSEVKLHLDIEGHA<br>SHYTIPWTELMAKVPGLSPEALWREANVTEDLASMLNRYKLIYKTSGTLGIALAEPVDIPAVSEGSMQVDASKVHPGVISGLNSPACMLSA<br>PLEKQLFYYIGTMLPNTRPHSYVFYQLRCHLSYVALSINGDKFQYTGAMTSKFLMGTYKRVTEKGDEHVLSLVFGKTKDLPDLRGPFSYPS<br>LTSAQSGDYSLVIVTTFVHYANFHNYFVPNLKDMFSRAVTMTAASYARYVLQKLVLLEMKGGCREPELDTETLTTMFEVSVAFFKVGHAVG<br>ETGNGCVDLRWLAKSFFELTVLKDIIGICYGATVKGMQSYGLERLAAMLMATVKMEELGHLTTEKQEYALRLATVGYPKAGVYSGLIGGAT<br>SVLLSAYNRHPLFQPLHTVMRETLFIGSHVVLRELRLNVTTQGPNLALYQLLSTALCSALEIGEVLRGLALGTESGLFSPCYLSLRFDLTR<br>DKLLSMAPQEATLDQAAVSNAVDGFLGRLSLEREDRDAWHLPAYKCVDRLDKVLMIIPLINVTFIISSDREVRGSALYEASTTYLSSSLFL<br>SPVIMNKCSQGAVAGEPRQIPKIQNFTRTQKSCIFCGFALLSYDEKEGLETTTYITSQEVQNSILSSNYFDFDNLHVHYLLLTTNGTVMEI<br>AGLYEERASGSGYIPEAPRDGQAYVRKDGEWVLLSTFLGSGSGSGLVPRGSGAGGGHHHHHH | |
| SIB 7403<br>leader sequence<br>gL_linker_gH_trimer | MRAVGVFLAICLVTIFVLPTWGNWAYPCCHVTQLRAQHLLALENISDIYLVSNQTCDGESLASLNSPKNGSNQLVISRCANGLNVVSFFIS<br>ILKRSSSALTGHLRELLTTLETLYGSFSVEDLFGANLNRYAWHRGGGGSGSASSGASASGSSNGSGSGSGSNSSASSGASSGGASGGSGGS<br>GAASLSEVKLHLDIEGHASHYTIPWTELMAKVPGLSPEALWREANVTEDLASMLNRYKLIYKTSGTLGIALAEPVDIPAVSEGSMQVDASK<br>VHPGVISGLNSPACMLSAPLEKQLFYYIGTMLPNTRPHSYVFYQLRCHLSYVALSINGDKFQYTGAMTSKFLMGTYKRVTEKGDEHVLSLV<br>FGKTKDLPDLRGPFSYPSLTSAQSGDYSLVIVTTFVHYANFHNYFVPNLKDMFSRAVTMTAASYARYVLQKLVLLEMKGGCREPELDTETL<br>TTMFEVSVAFFKVGHAVGETGNGCVDLRWLAKSFFELTVLKDIIGICYGATVKGMQSYGLERLAAMLMATVKMEELGHLTTEKQEYALRLA<br>TVGYPKAGVYSGLIGGATSVLLSAYNRHPLFQPLHTVMRETLFIGSHVVLRELRLNVTTQGPNLALYQLLSTALCSALEIGEVLRGLALGT<br>ESGLFSPCYLSLRFDLTRDKLLSMAPQEATLDQAAVSNAVDGFLGRLSLEREDRDAWHLPAYKCVDRLDKVLMIIPLINVTFIISSDREVR<br>GSALYEASTTYLSSSLFLSPVIMNKCSQGAVAGEPRQIPKIQNFTRTQKSCIFCGFALLSYDEKEGLETTTYITSQEVQNSILSSNYFDFD<br>NLHVHYLLLTTNGTVMEIAGLYEERASGSGYIPEAPRDGQAYVRKDGEWVLLSTFLGSGSGSGLVPRGSGAGGGHHHHHH | 412 |
| SIB 7404<br>leader sequence<br>gL_linker_gH bfpFerr<br>Nanoparticle<br>N19Q/C31S/S111C | MRAVGVFLAICLVTIFVLPTWGNWAYPCCHVTQLRAQHLLALENISDIYLVSNQTCDGESLASLNSPKNGSNQLVISRCANGLNVVSFFIS<br>ILKRSSSALTGHLRELLTTLETLYGSFSVEDLFGANLNRYAWHRGGGGSGSGSNSSASSGASSGGASGGSGGSGAASLSEVKLHLDIEGHA<br>SHYTIPWTELMAKVPGLSPEALWREANVTEDLASMLNRYKLIYKTSGTLGIALAEPVDIPAVSEGSMQVDASKVHPGVISGLNSPACMLSA<br>PLEKQLFYYIGTMLPNTRPHSYVFYQLRCHLSYVALSINGDKFQYTGAMTSKFLMGTYKRVTEKGDEHVLSLVFGKTKDLPDLRGPFSYPS<br>LTSAQSGDYSLVIVTTFVHYANFHNYFVPNLKDMFSRAVTMTAASYARYVLQKLVLLEMKGGCREPELDTETLTTMFEVSVAFFKVGHAVG<br>ETGNGCVDLRWLAKSFFELTVLKDIIGICYGATVKGMQSYGLERLAAMLMATVKMEELGHLTTEKQEYALRLATVGYPKAGVYSGLIGGAT<br>SVLLSAYNRHPLFQPLHTVMRETLFIGSHVVLRELRLNVTTQGPNLALYQLLSTALCSALEIGEVLRGLALGTESGLFSPCYLSLRFDLTR<br>DKLLSMAPQEATLDQAAVSNAVDGFLGRLSLEREDRDAWHLPAYKCVDRLDKVLMIIPLINVTFIISSDREVRGSALYEASTTYLSSSLFL<br>SPVIMNKCSQGAVAGEPRQIPKIQNFTRTQKSCIFCGFALLSYDEKEGLETTTYITSQEVQNSILSSNYFDFDNLHVHYLLLTTNGTVMEI<br>AGLYEERASGGGSGGGSGGGSGGGSGGGSESQVRQQFSKDIEKLLNEQVNKEMQSSNLYMSMSSWSYTHSLDGAGLFLFDHAAEEYEHAKK<br>LIIFLNENNVPVQLTSIDAPEHKFEGLTQIFQKAYEHEQHISEDINNIVDHAIKCKDHATFNFLQWYVAEQHEEEVLFKDILDKIELIGNE<br>NHGLYLADQYVKGIAKDRKS | 413 |
| SIB 7406<br>leader sequence<br>gL_linker_gH bfpFerr<br>Nanoparticle<br>N19Q/C31S/S111C | MRAVGVFLAICLVTIFVLPTWGNWAYPCCHVTQLRAQHLLALENISDIYLVSNQTCDGFSLASLNSPKNGSNQLVISRCANGLNVVSFFIS<br>ILKRSSSALTGHLRELLTTLETLYGSFSVEDLFGANLNRYAWHRGGGGSGSASSGASASGSSNGSGSGSGSNSSASSGASSGGASGGSGGS<br>GAASLSEVKLHLDIEGHASHYTIPWTELMAKVPGLSPEALWREANVTEDLASMLNRYKLIYKTSGTLGIALAEPVDIPAVSEGSMQVDASK<br>VHPGVISGLNSPACMLSAPLEKQLFYYIGTMLPNTRPHSYVFYQLRCHLSYVALSINGDKFQYTGAMTSKFLMGTYKRVTEKGDEHVLSLV<br>FGKTKDLPDLRGPFSYPSLTSAQSGDYSLVIVTTFVHYANFHNYFVPNLKDMFSRAVTMTAASYARYVLQKLVLLEMKGGCREPELDTETL<br>TTMFEVSVAFFKVGHAVGETGNGCVDLRWLAKSFFELTVLKDIIGICYGATVKGMQSYGLERLAAMLMATVKMEELGHLTTEKQEYALRLA<br>TVGYPKAGVYSGLIGGATSVLLSAYNRHPLFQPLHTVMRETLFIGSHVVLRELRLNVTTQGPNLALYQLLSTALCSALEIGEVLRGLALGT<br>ESGLFSPCYLSLRFDLTRDKLLSMAPQEATLDQAAVSNAVDGFLGRLSLEREDRDAWHLPAYKCVDRLDKVLMIIPLINVTFIISSDREVR<br>GSALYEASTTYLSSSLFLSPVIMNKCSQGAVAGEPRQIPKIQNFTRTQKSCIFCGFALLSYDEKEGLETTTYITSQEVQNSILSSNYFDFD<br>NLHVHYLLLTTNGTVMEIAGLYEERASGGGSGGGSGGGSGGGSGGGSESQVRQQFSKDIEKLLNEQVNKEMQSSNLYMSMSSWSYTHSLDG | 414 |

TABLE 1-continued

| (Sequence Table): Description of the Sequences | | |
|---|---|---|
| Description | Sequences | SEQ ID NO |
| | AGLFLFDHAAEEYEHAKKLIIFLNENNVPVQLTSISAPEHKFEGLTQIFQKAYEHEQHISESINNIVDHAIKCKDHATFNFLQWYVAEQHE<br>EEVLFKDILDKIELIGNENHGLYLADQYVKGIAKDRKS | |
| SIB 7414<br>leader sequence<br>gL_linker_gH Monomer | METDTLLLWVLLLWVPGSTGNWAYPCCHVTQLRAQHLLALENISDIYLVSNQTCDGFSLASLNSPKNGSNQLVISRCANGLNVVSFFISIL<br>KRSSSALTGHLRELLTTLETLYGSFSVEDLFGANLNRYAWHRGGGGGGSGGGGSGGGGSGAASLSEVKLHLDIEGHASHYTIPWTELMAKV<br>PGLSPEALWREANVTEDLASMLNRYKLIYKTSGTLGIALAEPVDIPAVSEGSMQVDASKVHPGVISGLNSPACMLSAPLEKQLFYYIGTML<br>PNTRPHSYVFYQLRCHLSYVALSINGDKFQYTGAMTSKFLMGTYKRVTEKGDEHVLSLVFGKTKDLPDLRGPFSYPSLTSAQSGDYSLVIV<br>TTFVHYANFHNYFVPNLKDMFSRAVTMTAASYARYVLQKLVLLEMKGGCREPELDTETLTTMFEVSVAFFKVGHAVGETGNGCVDLRWLAK<br>SFFELTVLKDIIGICYGATVKGMQSYGLERLAAMLMATVKMEELGHLTTEKQEYALRLATVGYPKAGVYSGLIGGATSVLLSAYNRHPLFQ<br>PLHTVMRETLFIGSHVVLRELRLNVTTQGPNLALYQLLSTALCSALEIGEVLRGLALGTESGLFSPCYLSLRFDLTRDKLLSMAPQEATLD<br>QAAVSNAVDGFLGRLSLEREDRDAWHLPAYKCVDRLDKVLMIIPLINVTFIISSDREVRGSALYEASTTYLSSSLFLSPVIMNKCSQGAVA<br>GEPRQIPKIQNFTRTQKSCIFCGFALLSYDEKEGLETTTYITSQEVQNSILSSNYFDFDNLHVHYLLLTTNGTVMEIAGLYEERASGSGSG<br>SGLVPRGSGAGGGHHHHHH | 415 |
| SIB 7429<br>leader sequence<br>gL_linker_gH_trimer | METDTLLLWVLLLWVPGSTGNWAYPCCHVTQLRAQHLLALENISDIYLVSNQTCDGFSLASLNSPKNGSNQLVISRCANGLNVVSFFISIL<br>KRSSSALTGHLRELLTTLETLYGSFSVEDLFGANLNRYAWHRGGGGGGSGGGGSGGGGSGAASLSEVKLHLDIEGHASHYTIPWTELMAKV<br>PGLSPEALWREANVTEDLASMLNRYKLIYKTSGTLGIALAEPVDIPAVSEGSMQVDASKVHPGVISGLNSPACMLSAPLEKQLFYYIGTML<br>PNTRPHSYVFYQLRCHLSYVALSINGDKFQYTGAMTSKFLMGTYKRVTEKGDEHVLSLVFGKTKDLPDLRGPFSYPSLTSAQSGDYSLVIV<br>TTFVHYANFHNYFVPNLKDMFSRAVTMTAASYARYVLQKLVLLEMKGGCREPELDTETLTTMFEVSVAFFKVGHAVGETGNGCVDLRWLAK<br>SFFELTVLKDIIGICYGATVKGMQSYGLERLAAMLMATVKMEELGHLTTEKQEYALRLATVGYPKAGVYSGLIGGATSVLLSAYNRHPLFQ<br>PLHTVMRETLFIGSHVVLRELRLNVTTQGPNLALYQLLSTALCSALEIGEVLRGLALGTESGLFSPCYLSLRFDLTRDKLLSMAPQEATLD<br>QAAVSNAVDGFLGRLSLEREDRDAWHLPAYKCVDRLDKVLMIIPLINVTFIISSDREVRGSALYEASTTYLSSSLFLSPVIMNKCSQGAVA<br>GEPRQIPKIQNFTRTQKSCIFCGFALLSYDEKEGLETTTYITSQEVQNSILSSNYFDFDNLHVHYLLLTTNGTVMEIAGLYEERASGSGYI<br>PEAPRDGQAYVRKDGEWVLLSTFLGSGSGSGLVPRGSGAGGGHHHHHH | 416 |
| SIB 15000<br>leader sequence<br>gL_FR1_gH bfpFerr<br>Nanoparticle<br>N19Q/C31S/S111C | MRAVGVFLAICLVTIFVLPTWGNWAYPCCHVTQLRACHLLALENISDIYLVSNQTCDGESLASLNSPKNGSNCLVISRCANGLNVVSFFIS<br>ILKRSSSALTGHLRELLTTLETLYGSFSVEDLFGANLNRYAWHRGGGGSGSASAEAAAKEAAAKAGGSGGSGAASLSEVKLHLDIEGHASH<br>YTIPWTELMAKVPGLSPEALWREANVTEDLASMLNRYKLIYKTSGTLGIALAEPVDIPAVSEGSMQVDASKVHPGVISGLNSPACMLSAPL<br>EKQLFYYIGTMLPNTRPHSYVFYQLRCHLSYVALSINGDKFQYTGAMTSKFLMGTYKRVTEKGDEHVLSLVFGKTKDLPDLRGPFSYPSLT<br>SAQSGDYSLVIVTTFVHYANFHNYFVPNLKDMFSRAVTMTAASYARYVLQKLVLLEMKGGCREPELDTETLTTMFEVSVAFFKVGHAVGET<br>GNGCVDLRWLAKSFFELTVLKDIIGICYGATVKGMQSYGLERLAAMLMATVKMEELGHLTTEKQEYALRLATVGYPKAGVYSGLIGGATSV<br>LLSAYNRHPLFQPLHTVMRETLFIGSHVVLRELRLNVTTQGPNLALYQLLSTALCSALEIGEVLRGLALGTESGLFSPCYLSLRFDLTRDK<br>LLSMAPQEATLDQAAVSNAVDGFLGRLSLEREDRDAWHLPAYKCVDRLDKVLMIIPLINVTFIISSDREVRGSALYEASTTYLSSSLFLSP<br>VIMNKCSQGAVAGEPRQIPKIQNFTRTQKSCIFCGFALLSYDEKEGLETTTYITSQEVQNSILSSNYFDFDNLHVHYLLLTTNGTVMEIAG<br>LYEERASGGGSGGGSGGGSGGGSGGGSESQVRQQFSKDIEKLLNEQVNKEMQSSNLYMSMSSWSYTHSLDGAGLFLFDHAAEEYEHAKKLI<br>IFLNENNVPVQLTSISAPEHKFEGLTQIFQKAYEHEQHISESINNIVDHAIKCKDHATFNFLQWYVAEQHEEEVLFKDILDKIELIGNENH<br>GLYLADQYVKGIAKSRKS | 417 |
| SIB 15001<br>leader sequence<br>gL_FR2_gH bfpFerr<br>Nanoparticle | MRAVGVFLAICLVTIFVLPTWGNWAYPCCHVTQLRACHLLALENISDIYLVSNQTCDGESLASLNSPKNGSNCLVISRCANGLNVVSFFIS<br>ILKRSSSALTGHLRELLTTLETLYGSFSVEDLFGANLNRYAWHRGGGGSGSASAEAAAKEAAAKEAAAKASGGSGGSGAASLSEVKLHLDI<br>EGHASHYTIPWTELMAKVPGLSPEALWREANVTEDLASMLNRYKLIYKTSGTLGIALAEPVDIPAVSEGSMQVDASKVHPGVISGLNSPAC<br>MLSAPLEKQLFYYIGTMLPNTRPHSYVFYQLRCHLSYVALSINGDKFQYTGAMTSKFLMGTYKRVTEKGDEHVLSLVFGKTKDLPDLRGPF | 418 |

TABLE 1-continued (Sequence Table): Description of the Sequences

| Description | Sequences | SEQ ID NO |
|---|---|---|
| N19Q/C31S/S111C | SYPSLTSAQSGDYSLVIVTTFVHYANFHNYFVPNLKDMFSRAVTMTAASYARYVLQKLVLLEMKGGCREPELDTETLTMFEVSVAFFKVG HAVGETGNGCVDLRWLAKSFFELTVLKDIIGICYGATVKGMQSYGLERLAAMLMATVKMEELGHLTTEKQEYALRLATVGYPKAGVYSGLI GGATSVLLSAYNRHPLFQPLHTVMRETLFIGSHVVLRELRLNVTTQGPNLALYQLLSTALCSALEIGEVLRGLALGTESGLFSPCYLSLRF DLTRDKLLSMAPQEATLDQAAVSNAVDGFLGRLLSEREDRDAWHLPAYKCVDRLDKVLMIIPLINVTFIISSDREVRGSALYEASTTYLSS SLFLSPVIMNKCSQGAVAGEPRQIPKIQNFTRTQKSCIFCGFALLSYDEKEGLETTTYITSQEVQNSILSSNYFDFDNLHVYHLLLTTNGT VMEIAGLYEERASGGGSGGGSGGGSGGGSESVRQQFSKDIEKLLNEQVNKEMQSSNLYMSMSSWSYTHSLDGAGLFLFDHAAEEVE HAKKLIIFLNENNVPVQLTSISAPEHKFEGLTQIFQKAYEHEQHLSESINNIVDHAIKCKDHATFNFLQWYVAEQHEEEVLFKDILDKIEL IGNENHGLYLADQVVKGIAKSRKS | 419 |
| SIB 15002 leader sequence Construct 5

TABLE 1-continued (Sequence Table): Description of the Sequences

| Description | Sequences | SEQ ID NO |
|---|---|---|
| SIB 15005 leader sequence Construct 5 gL_gH_C137A_bfpFerr Nanoparticle N19Q/C31S/S111C | ESGLFSPCYLSRLRFDLTRDKLLSMAPQEATLDQAAVSNAVDGFLGRLSLEREDRDAWHLPAYKCVDRLDKVLMIIPLINVTFIISSDREVR GSAIYEASTTYLSSSLFLSPVIMNKCSQGAVAGEPRQIPKIQNFTRTQKSCIFCGFALLSYDEKEGLETTYITSQEVQNSILSSNYFPDD NLHVYLLLTTNGTVMEIAGLYEERASGGGSGGGSSGGSGSGGSASGSSGSGSGSASGSSGSGSGSASGSSGSGSGSASGSSGSGSGSASGSSGSGSGSASGSSGSGSGSASGSSGSGSGSASGSSGSGSGSASGSSGSGSGSAS PRVRGGGRVAAAAITWVPKPNVEVWPVDPPPPVNFNKTAEQEYGDKEVKLPHWTPTLHHTFQVPQNYTRKANCTYCNTREYTFSYKGCCFYFT KKKHTWNGCFQACAELYPCTYFYGPTPDILPVVITRNLNAIESLMVGYIRVGEGNWTSLDGGTFKVYQIFGSHCTYVSKFSTVPVSHHECSF LKPCLCVSQRSNSGGSASGSSGSGSGSASGSSGSGSGSASGSSGSGSGSASGSSGSGSGSASGSSGSGSGSASGSSGSGSGSASGSSGSGSGSASGSSGSGSGSASGSSGSGSGSASGSSGSGSGSASG GASGSGGGSGESQVRQQFSKDIEKLLNEQVNKEMQSSNLYMSMSSWSYTHSLDGAGLFLFDHAAEEVLFKDILDKIELIGNENHGLYLADQYVKGIAKSRK PEHKFEGLTQIFQKAYEHEQHISESINNIVDHAIKCKDHATFNFLQWYVAEQHEEEVLFLQWYVAEQHEEEVLFKDILDKIELIGNENHGLYLADQYVKGIAKSRK S | 422 |
| SIB 15006 leader sequence Construct 7 gL_gH_C137A_bfpFerr Nanoparticle N19Q/C31S | MRAVGVFLAICLVTIFVLPTWGNWAYPCCHVTQLRAQHLLALENISDIYLVSNQTCDGFSLASLNSPKNGSNQLVISRCANGLNVVSFFIS ILKRSSSALTGHLRELLTTLETIYGSFSVEDLFGANLNRYAWHRGGGSGGSGASGSSNNGSGGSGSGSASGSSSGSGSGSASGSSGSGSGSAS GAASLSEVKLHLDIEGHASHYTIPWTELMAKVPGLSPEALWREANVTEDLASMLNRYKLIYKTSGTLGLALAEFVDIPAVSEGSMQVDASK VHPGVISGLNSPACMLSAPLEKQLFYYIGTMLPNTRPHSVYFYQLRAHLSYVALSINGDKFQTTGAMTSKFLMGTYKRVTEKGDEHVLSLV FGKTKDLPDLRGPFSYPSLTSAQSGDYSLVIVTTFVHYANFHNYFVPNLKDMFSRAVTMTAASYARYVLQKLVLLEMKGGCREPELDTETL TTMFEVSVARFFKVGHAVGETGNGCVDLRWLAKSFFELTVLKDIIGICYGATVKGMQSYGLERLAAMLMATVKMEELGHLTTEKQEYALRLA TVGIYPKAGYTYSGLIGGATSVLLSAYNRHPLFQPLHTVMRETLFIGSHVVLRELRLNVTTQGPNLALYQLLSTALCSALEIGEVLRGLALGT ESGLFSPCYLSRLRFDLTRDKLLSMAPQEATLDQAAVSNAVDGFLGRLSLEREDRDAWHLPAYKCVDRLDKVLMIIPLINVTFIISSDREVR GSAIYEASTTYLSSSLFLSPVIMNKCSQGAVAGEPRQIPKIQNFTRTQKSCIFCGFALLSYDEKEGLETTYITSQEVQNSILSSNYFPDD NLHVYLLLTTNGTVMEIAGLYEERASGGGSGGGSSGGSGSGGSASGSSGSGSGSASGSSGSGSGSASGSSGSGSGSGSGESQVRQQFSKDIEKLLNE QVNKEMQSSNLYMSMSSWSYTHSLDGAGLFLFDHAAEEVLFKDILDKIELIGNENHGLYLADQYVKGIAKSRKS IVDHAIKCKDHATFNFLQWYVAEQHEEEVLFKDILDKIELIGNENHGLYLADQVVKGIAKSRKS | 423 |
| SIB 17395 leader sequence gp220-T. ni ferritin heavy chain | MDSKGSSQKGSRLLLLLVSNLLLPQGVLAEEAALLVCQYTIQSLIHLTGEDPGFFNVEIPEFPYPTCNVCTADVNVIINFDVGGKKHQLD LDFGQLTPHTKAVYQPRGAFGGSENATNLFILELLGAGELALATMRSKKLPINVTTGEEQVSLSESVDVFQDVFGTMWCHHAEMQNPVLI PETVPYIKWDNCNSTNITAVVRAQGLDTVLPLSLPTSAQDSNFSVKTEMLGNEIDIECIMEDGEISQVLPGDNKFNITCSGYESHVPSGGI LTSTSPVATPIPGTGYAYSLRLTPRPVSRPGNNSILLVVFYSGNGPKASGGDYCIQSNIVFSDEIPASQDMPTNTTDITYVGDNATYSVPM VTSEDANSPNVTVTAFWAWPNNTETDFKCKWTLLTSGTPSGCENISGAFASNRTFDITVSGLGTAPKTLIITRATNATTTHKVIFSKAPE GSTQCNVNPVQIPKDWITMHRSCRNSMRQQIQMEVGASLQYLAMGAHFSKDVVNRPGFAQLFFDAASEEREHAMKLIEYLLMRGELTNDVS | 424 |

TABLE 1-continued (Sequence Table): Description of the Sequences

| Description | Sequences | SEQ ID NO |
|---|---|---|
| SIB 17396 leader sequence gL_linker_gH-T. ni ferritin heavy chain | SLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV | 425 |
|  | MRAVGVFLAICLVIIFVLPTWGNWAYPCCHVTQLRAQHLLALENISDIVLVSNQTCDGFSLASLNSPKNGSNQLVISRCANGLNVVSFFISILKRSSSALTGHLRELLTTLETLYGSFSVEDLFGANLNRYAWHRGGGSGSASGSASGSSNGGSGSGSNSSASGSASSGGASGGSGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAPFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAXNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTYITSQEVQNSILSSNYFDFDNLHVHYLLLTTNGTVMEIAGLYEERASGSTQCNVNPVQIPKDMITMHRSCRNSMROQIQMEVGASLQYLAMGAHFSKDVVNRPGFAQLFFDAASEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV |  |
| SIB 17397 leader sequence gp220-T. ni ferritin light chain | MDSKGSSQKGSRLLLLVVSNLLLPQGVLAEAALLVCQYTIQSLIHLTGEDPGFFNVEIPEFPFYPTCNVCTADVNVIINFDVGGKKHQLDLDFGQLTPHTKAVYQPRGAFGGSENATNLFILELLGAGELALTMRSKKLPINVTTGEEEQQVSLESVDVYFQDVFGTMWCHHAEMQNPVVLIPETVPYIKWDNCNSTNITAVVRAQGLDVTLPLSLPTSAQDSNFSVKTEMLGNEIDIECIMEDGEISQVLPGDNKFNITCSGYESHVPSGGILTSTSPVATPIPGTGYAYSLRLTPRPVSRFIGNNSILLYVFFYSGNGPKASGGDYCIQSNIVFSDEIPASQDMPTNTDITYVGDNATYSVPMVTSEDANSPNVTVTAFWAWPNNTETDFKCKWTLTSGTPSGCENISGAFASNRTFDITVSGLGTAPKTLIITRATNATTTTHKVIFSKAPEGSADTCYNDVALDCGITSNSLALPRCNAVVGEYGSHGNVATELQAYAKLHLERSYDYLLSAAYFNNYQTNRAGFSKLFFKKLSDEAWSKTIDIIKHVTKRGDKMNFDQHSTMKTERKNYTAENHELEALAKALDTQKELAERAFYIHREATRNSQHLHDPEIAQYLEEFFIEDHAEKIRTLAGHTSDLKKFITANNGHDLSLALYVFDEYLQKTV | 426 |
| SIB 17398 leader sequence gL_linker_gH-T. ni ferritin light chain | MRAVGVFLAICLVIIFVLPTWGNWAYPCCHVTQLRAQHLLALENISDIVLVSNQTCDGFSLASLNSPKNGSNQLVISRCANGLNVVSFFISILKRSSSALTGHLRELLTTLETLYGSFSVEDLFGANLNRYAWHRGGGSGSASGSASGSSNGGSGSGSNSSASGSASSGGASGGSGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAPFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAXNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTYITSQEVQNSILSSNYFDFDNLHVHYLLLTTNGTVMEIAGLYEERASGSADTCYNDVALDCGITSNSLALPRCNAVYGEYGSHNVATELQAYAKLHLERSYDYLLSAAYFNNYQTNRAGFSKLFFKKLSDEAWSKTIDIIKHVTKRGDKMNFDQHSTMKTERKNYTAENHELEALAKALDTQKELAERAFYIHREATRNSQHLHDPEIAQYLEEFFIEDHAEKIRTLAGHTSDLKKFITANNGHDLSLALYVFDEYLQKTV | 427 |
| 16 amino acid linker | GGGGSGGGGSGGGGSG | 428 |
| 28 amino acid linker | GGGSGSGSNSSASGSASGGASGGSGSG | 429 |
| 46 amino acid linker | GGGSASSGASGSASGSSNGGSGSGSNSSASGSASSGGASGGSGSG | 430 |
| FR1 | GGSGSASAEAAAKEAAAKAGGSGSG | 431 |
| FR2 | GGSGSASAEAAAKEAAAKEAAAKASGGSGSG | 432 |

TABLE 1-continued (Sequence Table): Description of the Sequences

| Description | Sequences | SEQ ID NO |
|---|---|---|
| 47 amino acid linker comprising a C for conjugation | SGGGSGSASSGASGSSCSGSGSSSASSGASSGGASGGGSGGSG | 433 |
| Gp42 | DSKGSSQKGSRLLLLLVVSNLLLPQGVLAYFLPPRVRGGGRVAAAAITWVPKPNVEWPVDPPPVNFNKTAEQEYGDKEVKLPHWTPTLH TFQVPQNYTKANCTYCNTREYTFSYKGCCFYFTKKKHTWNGCFQACAELYPCTYFYGPTPDILPVVTRNLNAIESLWVGVYRVGEGNWTSL DGGTPKVYQIFGSHCTYVSKFSTVPVSHHECSFLKPCLCVSQRSNS | 434 |
| CpG (phosphorothioate modifications where * is shown) | T*G*A*C*T*G*T*G*A*A*C*G*T*T*C*G*A*G*A*T*G*A | 435 |
| Exemplary gL polypeptide | NWAYPCCHVTQLRAQHLLALENISDIYLVSNQTCDGFSLASLNSPKNGSNQLVISRCANGLNVVSFFISILKRSSSALTGHLRELLTTLET LYGSFSVEDLFGANLNRYAWHRGG | 436 |
| Exemplary gH polypeptide | AASLSEVKLHLDIEGHASHYTIPWTELMAKVPGLSPEALWREANVTEDLASMLNRYKLIYKTSGTLGIALAEPVDIPAVSEGSMQVDASKV HPGVISGLNSPACMLSAPLEKQLFYIGTMLPNTRPHSYVFYQLRCHLSYVALSINGDKFQYTGAMTSKFLMGTYKRVTEKGDEHVLSLVF GKTKDLDPLRGPFSYPSLTSAQSGDYSLVIVTFVHYANFHNYFVPNLKDMFSRAVTMTAASYARYVLQKLIVLLEMKGGCREPELDTETLT TMFEVSVAPFKVGHAVGETGNGCVDLRWLAKSFFELTVLKDIIGICYGATVKGMQSYGLERLAAMLMATVKMEELGHLTEKQEYALRLAT VGYPKAGVYSGLIGATSVLLSAYNRHPLFQPLHTVMRETLFIGSHVLRELRLNVTTQGPNLALYQLLSTALCSALEIGEVLRGLALGTE SGLFSPCYLSLRFDLTRDKLLSMAPQEATLDQAAVSNAVDGFLGRLSLEREDRDAWHLPAYKCVDRLDKVLMIIPLINVTFIISSDREVRG SALYEASTTYLSSSLFLSPVIMNCCSQGAVAGEPRQIPKIQNFTRTQKSCIFCGFALLSYDEKEGLETTYITSQEVQNSILSSNYFDFDN LHVHYLLLTTNGTVMEIAGLYEERA | 437 |
| Exemplary gp220 polypeptide | EAALLVCQYTIQSLIHLTGEDPGFFNVEIPEFPFYPTCNVCTADVNVTINFDVGGKKHQLDLDFGQLTPHTKAVYQPRGAFGGSENATNLF LLELLGAGELALTMRSKKLPINVTGEEQQVSLESVDVFQDVFGTMWCHHAEMQNPVLIPETVPYIKWDNCNSTNITAVVRAQGLDVTL PLSLPTSAQDSNFSVKTEMLGNEIDIECIMEDGEISQVLPGDNKPNITCSGYESHVPSGGILTSTSPVATPIPGTGYAYSLRLTPRPVSRF LGNNSILYVFYSGNGPKASGDYCIQSNIVFSDEIPASQDMPTNTDIITYVGDNATYSVPMVTSEDANSPNVTVTAFWAWPNNTETDFKCK WTLITSGTPSGCENISGAFASNRTFDITVSGLGTAPKTLIITRTATNATTTHKVIFSKAPE | 438 |
| Cysteine-Thrombin-His Linker (cysteine is double underlined) | <u><u>C</u></u>LVPRGSLEHHHHHH | 439 |
| Lumazine synthase of Aquifex aeolicus (strain VF5) | MQIYEGKLTAEGLRPGIVASRFNHALVDRLVEGAIDCIVRHGGREEDITLVRPGSWEIPVAAGELARKEDIDAVIAIGVLIRGATPHFDY IASEVSKGLANLSLELRKPITFGVITADTLEQATERAGTKHGNKGWEAALSAIEMANLFKSLR | 440 |
| E. coli 6,7-dimethyl-8-ribityllumazine synthase | MNITEANVATPDARVAITIARFNNFINDSLLEGAIDALKRIGQVKDENITVVWVPGAYELPLAAGALAKTGKYDAVIALGTVIRGGTAHFE YVAGGASNGLAHVAQDSEIPVAFGVLTTESIEQATERAGTKAGNKGAEAALTALEMINVLKAIKA | 441 |
| Hexa-His Tag | HHHHHH | 442 |
| glycine-serine linker | GGGS | 443 |
| glycine-serine linker | GGGSGGGS | 444 |
| glycine-serine linker | GGGSGGGSGGGSGGGSGGGS | 445 |
| | Not used | 446-500 |

TABLE 1-continued (Sequence Table): Description of the Sequences

| Description | Sequences | SEQ ID NO |
|---|---|---|
| RF8085 NIH DS-CAV1 with single chain linker SGSGS (SEQ ID NO: 533) on bullfrog (bf) hp ferritin N19Q_C31S_S111C (control) (same protein sequence as 502, expressed with transient transfection cloning vector) | MELLILKANAITTILTAVTFCFASGQNITEEFYQSTCSAVSKGYLSALRTGWYTSVITIELSNIKENKCNGTDAKVKLIKQELDKYKNAVT<br>ELQLLMGSGNVGLGGAIASGVAVCKVLHLEGEVNKIKSALLSTNKAVVSLSNGVSVLTFKVLDLKNYIDKQLLPILNKQSCSISNIETVIE<br>FQQKNNRLLEITREFSVNAGVTTPVSTYMLTNSELLSLINDMPITNDQKKLMSNNVQIVRQQSYSIMCIIKEEVLAYVVQLPLYGVIDTPC<br>WKLHTSPLCTTNTKEGSNICLTRTDRGWYCDNAGSVSFFPQAETCKVQSNRVFCDTMNSRTLPSEVNLCNVDIFNPKYDCKIMTSKTDVSS<br>SVITSLGAIVSCYGKTKCTASNKNRGIIKTFSNGCDYVSNKGVDTVSVGNTLYYVNKQEGKSLYVKGEPIINFYDPLVFPSDEFDASISQV<br>NEKINQSLAFIRKSDELLSGSGSESQVRQQFSKDIEKLLNEQVNKEMQSSNLYMSMSSWSYTHSLDGAGLFLFDHAAEEYEHAKKLIIFLN<br>ENNVPVQLTSISAPEHKFEGLTQIFQKAYEHEQHISESINNIVDHAIKCKDHATFNFLQWYVAEQHEEEVLFKDILDKIELIGNENHGLYL<br>ADQYVKGIAKSRKS | 501 |
| RF8090: NIH DS-CAV1 with single chain linker SGSGS (SEQ ID NO: 533) on bullfrog (bf )hp ferritin N19Q_C31S_S111C (control) (same protein sequence as 501, expressed with cloning vector used for CHO cell line generation | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVCKVLHLEGEVNKIKSALLSTNKAVVSLSNGVSVLTFKVLDLKNYIDKQLLPILNKQSCSISNIETVIEF<br>QQKNNRLLEITREFSVNAGVTTPVSTYMLTNSELLSLINDMPITNDQKKLMSNNVQIVRQQSYSIMCIIKEEVLAYVVQLPLYGVIDTPCW<br>KLHTSPLCTTNTKEGSNICLTRTDRGWYCDNAGSVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN<br>EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | 502 |
| RF8100: Add a single T324N glycan site to RSV scF_SGSGS (SEQ ID NO: 533)-bf-pFerr_N19Q_C3 1S_S111C] | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVCKVLHLEGEVNKIKSALLSTNKAVVSLSNGVSVLTFKVLDLKNYIDKQLLPILNKQSCSISNIETVIEF<br>QQKNNRLLEITREFSVNAGVTTPVSTYMLTNSELLSLINDMPITNDQKKLMSNNVQIVRQQSYSIMCIIKEEVLAYVVQLPLYGVIDTPCW<br>KLHTSPLCTNNTKEGSNICLTRTDRGWYCDNAGSVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN<br>EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | 503 |
| RF8101: Add a single glycan site E328N to_ _RSV scF_SGSGS (SEQ ID NO: 533)-bf-pFerr_N19Q_C3 1S_S111C | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVCKVLHLEGEVNKIKSALLSTNKAVVSLSNGVSVLTFKVLDLKNYIDKQLLPILNKQSCSISNIETVIEF<br>QQKNNRLLEITREFSVNAGVTTPVSTYMLTNSELLSLINDMPITNDQKKLMSNNVQIVRQQSYSIMCIIKEEVLAYVVQLPLYGVIDTPCW<br>KLHTSPLCTTNTKNGSNICLTRTDRGWYCDNAGSVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN<br>EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | 504 |
| RF8102: Add a single glycan site _K390T_to RSVscF_SGSGS (SEQ ID NO: 533)-bf-pFerr_N19Q_C3 1S_S111C | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVCKVLHLEGEVNKIKSALLSTNKAVVSLSNGVSVLTFKVLDLKNYIDKQLLPILNKQSCSISNIETVIEF<br>QQKNNRLLEITREFSVNAGVTTPVSTYMLTNSELLSLINDMPITNDQKKLMSNNVQIVRQQSYSIMCIIKEEVLAYVVQLPLYGVIDTPCW<br>KLHTSPLCTTNTKEGSNICLTRTDRGWYCDNAGSVSFFPQAETCKVQSNRVFCDTMNSRTLPSEVNLCNVDIFNPTYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN<br>EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | 505 |
| RF8103: Add a single glycan site S348N_to RSVscF_SGSGS | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVCKVLHLEGEVNKIKSALLSTNKAVVSLSNGVSVLTFKVLDLKNYIDKQLLPILNKQSCSISNIETVIEF | 506 |

TABLE 1-continued

| (Sequence Table): Description of the Sequences | | |
|---|---|---|
| Description | Sequences | SEQ ID NO |
| (SEQ ID NO: 533)-bf-pFerr_N19Q_C3 1S S111C | QQKNNRLLEITREFSVNAGVTTPVSTYMLTNSELLSLINDMPITNDQKKLMSNNVQIVRQQSYSIMCIIKEEVLAYVVQLPLYGVIDTPCW<br>KLHTSPLCTTNTKEGSNICLTRTDRGWYCDNAGNVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN<br>EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | |
| RF8104: Add a single glycan site_Y478S_to RSVscF_SGSGS (SEQ ID NO: 533)-bf-pFerr_N19Q_C3 1S_S111C | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVCKVLHLEGEVNKIKSALLSTNKAVVSLSNGVSVLTFKVLDLKNYIDKQLLPILNKQSCSISNIETVIEF<br>QQKNNRLLEITREFSVNAGVTTPVSTYMLTNSELLSLINDMPITNDQKKLMSNNVQIVRQQSYSIMCIIKEEVLAYVVQLPLYGVIDTPCW<br>KLHTSPLCTTNTKEGSNICLTRTDRGWYCDNAGSVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFSDPLVFPSDEFDASISQVN<br>EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | 507 |
| RF8105: Add a single glycan site R507N_to RSVscF_SGSGS (SEQ ID NO: 533)-bf-pFerr_N19Q_C3 1S_S111C | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVCKVLHLEGEVNKIKSALLSTNKAVVSLSNGVSVLTFKVLDLKNYIDKQLLPILNKQSCSISNIETVIEF<br>QQKNNRLLEITREFSVNAGVTTPVSTYMLTNSELLSLINDMPITNDQKKLMSNNVQIVRQQSYSIMCIIKEEVLAYVVQLPLYGVIDTPCW<br>KLHTSPLCTTNTKEGSNICLTRTDRGWYCDNAGSVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN<br>EKINQSLAFINKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | 508 |
| RF8106: RF8108 with I217P that increases expression, and removal of disulfide bond (DS) of DS-CAV1 removed, resulting in even higher expression relative to RF8085 (or RF8090) | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVSKVLHLEGEVNKIKSALLSTNKAVVSLSNGVSVLTFKVLDLKNYIDKQLLPILNKQSCSISNPETVIEF<br>QQKNNRLLEITREFSVNAGVTTPVSTYMLTNSELLSLINDMPITNDQKKLMSNNVQIVRQQSYSIMSIIKEEVLAYVVQLPLYGVIDTPCW<br>KLHTSPLCTTNTKEGSNICLTRTDRGWYCDNAGSVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN<br>EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | 509 |
| RF8107: Proline substitution (I217P) of RF8108 and hydrophobic cavity filling substitution of RF8111 (N228L)together with removal of disulfide bond of DS-CAV1 | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVSKVLHLEGEVNKIKSALLSTNKAVVSLSNGVSVLTFKVLDLKNYIDKQLLPILNKQSCSISNPETVIEF<br>QQKNLRLLEITREFSVNAGVTTPVSTYMLTNSELLSLINDMPITNDQKKLMSNNVQIVRQQSYSIMSIIKEEVLAYVVQLPLYGVIDTPCW<br>KLHTSPLCTTNTKEGSNICLTRTDRGWYCDNAGSVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN<br>EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | 510 |
| RF8108: Proline substitution I217P stabilize pre-fusion central helix (while DS of DS-CAV1 present) and increase expression | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVCKVLHLEGEVNKIKSALLSTNKAVVSLSNGVSVLTFKVLDLKNYIDKQLLPILNKQSCSISNPETVIEF<br>QQKNNRLLEITREFSVNAGVTTPVSTYMLTNSELLSLINDMPITNDQKKLMSNNVQIVRQQSYSIMCIIKEEVLAYVVQLPLYGVIDTPCW<br>toKLHTSPLCTTNTKEGSNICLTRTDRGWYCDNAGSVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN | 511 |

TABLE 1-continued (Sequence Table): Description of the Sequences

| Description | Sequences | SEQ ID NO |
|---|---|---|
| | EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | |
| RF8109: Hydrophobic cavity filling_Q224L_ on RSVscF_SGSGS (SEQ ID NO: 533)-bf-pFerr_N19Q_C3 1S_S111C | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVCKVLHLEGEVNKIKSALLSTNKAVVSLSNGVSVLTFKVLDLKNYIDKQLLPILNKQSCSISNIETVIEF<br>LQKNNRLLEITREFSVNAGVTTPVSTYMLTNSELLSLINDMPITNDQKKLMSNNVQIVRQQSYSIMCIIKEEVLAYVVQLPLYGVIDTPCW<br>KLHTSPLCTTNTKEGSNICLTRTDRGWYCDNAGSVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN<br>EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | 512 |
| RF8110: Hydrophobic cavity filling substitutions Q224L and Q225V_on RSV scF_SGSGS (SEQ ID NO: 533)-bf-pFerr_N19Q_C3 1S_S111C | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVCKVLHLEGEVNKIKSALLSTNKAVVSLSNGVSVLTFKVLDLKNYIDKQLLPILNKQSCSISNIETVIEF<br>LVKNNRLLEITREFSVNAGVTTPVSTYMLTNSELLSLINDMPITNDQKKLMSNNVQIVRQQSYSIMCIIKEEVLAYVVQLPLYGVIDTPCW<br>KLHTSPLCTTNTKEGSNICLTRTDRGWYCDNAGSVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN<br>EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | 513 |
| RF8111: Hydrophobic cavity filling substitution N228L_on RSVscF_SGSGS (SEQ ID NO: 533)-bf-pFerr_N19Q_C3 1S_S111C | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVCKVLHLEGEVNKIKSALLSTNKAVVSLSNGVSVLTFKVLDLKNYIDKQLLPILNKQSCSISNIETVIEF<br>QQKNLRLLEITREFSVNAGVTTPVSTYMLTNSELLSLINDMPITNDQKKLMSNNVQIVRQQSYSIMCIIKEEVLAYVVQLPLYGVIDTPCW<br>KLHTSPLCTTNTKEGSNICLTRTDRGWYCDNAGSVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN<br>EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | 514 |
| RF8112 hydrophobic filling substitution N228F_RSVscF SGSGS (SEQ ID NO: 533)-bf-pFerr_N19Q_C3 1S_S111C | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVCKVLHLEGEVNKIKSALLSTNKAVVSLSNGVSVLTFKVLDLKNYIDKQLLPILNKQSCSISNIETVIEF<br>QQKNFRLLEITREFSVNAGVTTPVSTYMLTNSELLSLINDMPITNDQKKLMSNNVQIVRQQSYSIMCIIKEEVLAYVVQLPLYGVIDTPCW<br>KLHTSPLCTTNTKEGSNICLTRTDRGWYCDNAGSVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN<br>EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHKFEGLTQIFQKAYEHEQHISESINNIVDHAIKCKDHATFNFLQWYVAEQHEEEVLFKDILDKIELIGNENHGLYLA<br>DQYVKGIAKSRKS | 515 |
| RF8113 (I217P mutation of RF8106 while removing DS of DS-CAV1 and with ferritin Wt ser111 and engineered CYS of K79C for conjugation | MELLILKANAITTILTAVTFCFASGQNITEEFYQSTCSAVSKGYLSALRTGWYTSVITIELSNIKENKCNGTDAKVKLIKQELDKYKNAVTE<br>LQLLMGSGNVGLGGAIASGVAVSKVLHLEGEVNKIKSALLSTNKAVVSLSNGVSVLTFKVLDLKNYIDKQLLPILNKQSCSISNPETVIEF<br>QQKNNRLLEITREFSVNAGVTTPVSTYMLTNSELLSLINDMPITNDQKKLMSNNVQIVRQQSYSIMSIIKEEVLAYVVQLPLYGVIDTPCW<br>KLHTSPLCTTNTKEGSNICLTRTDRGWYCDNAGSVSFFPQAETCKVQSNRVFCDTMNSRTLPSEVNLCNVDIFNPKYDCKIMTSKTDVSSS<br>VITSLGAIVSCYGKTKCTASNKNRGIIKTFSNGCDYVSNKGVDTVSVGNTLYYVNKQEGKSLYVKGEPIINFYDPLVFPSDEFDASISQVN<br>EKINQSLAFIRKSDELLSGSGSESQVRQQFSKDIEKLLNEQVNKEMQSSNLYMSMSSWSYTHSLDGAGLFLFDHAAEEYEHAKKLIIFLNE<br>NNVPVQLTSISAPEHCFEGLTQIFQKAYEHEQHISESINNIVDHAIKSKDHATFNFLQWYVAEQHEEEVLFKDILDKIELIGNENHGLYLA<br>DQYVKGIAKSRKS | 516 |

TABLE 1-continued (Sequence Table): Description of the Sequences

| Description | Sequences | SEQ ID NO |
|---|---|---|
| RF8117 (Combinations of above successful improved expression/secretion mutations above (FIG. 76): No DS, I217P, E328N, S348N, R507N, ferritinK79C) | MELLILKANAITTILTAVTFCFASGQNITEEFYQSTCSAVSKGYLSALRTGWYTSVITIELSNIKENKCNGTDAKVLIKQELDKYKNAVT ELQLLMGSGNVGLGGAIASGVAVSKVLHLEGEVNKIKSALLSTNKAVVSLSNGVSVLTFKVLDLKNYIDKQLLPILNKQSCSISNPETVIE FQQKNNRLLEITREFSVNAGVTTPVSTYMLTNSELLSLINDMPITNDQKKLMSNNVQIVRQQSYSIMSIIKEEVLAYVVQLPLYGVIDTPC WKLHTSPLCTTNTKNGSNICLTRTDRGWYCDNAGNVSFFPQAETCKVQSNRVFCDTMNSRTLPSEVNLCNVDIFNPKYDCKIMTSKTDVSS SVITSLGAIVSCYGKTKCTASNKNRGIIKTFSNGCDYVSNKGVDTVSVGNTLYVNKQEGKSLVVKGEPIINFYDPLVFPSDEFDASISQV NEKINQSLAFINKSDELLSGSGSESQVRQQFSKDIEKLLNEQVNKEMQSSNLYMSMSSWSYTHSLDGAGLFLFDHAAEEYEHAKKLIIFLN ENNVPVQLTSISAPEHCCFEGLTQIFQKAYEHEQHISESINNIVDHAIKSKDHATFNFLQWYVAEQHEEEVLFKDILDKIELIGNENHGLYL ADQYVKGIAKSRKS | 517 |
| RF8122 (RF8117 above with additional K498L and K508Q for removing protease (LYS-based) cleavage and increased stability/expression) | MELLILKANAITTILTAVTFCFASGQNITEEFYQSTCSAVSKGYLSALRTGWYTSVITIELSNIKENKCNGTDAKVLIKQELDKYKNAVT ELQLLMGSGNVGLGGAIASGVAVSKVLHLEGEVNKIKSALLSTNKAVVSLSNGVSVLTFKVLDLKNYIDKQLLPILNKQSCSISNPETVIE FQQKNNRLLEITREFSVNAGVTTPVSTYMLTNSELLSLINDMPITNDQKKLMSNNVQIVRQQSYSIMSIIKEEVLAYVVQLPLYGVIDTPC WKLHTSPLCTTNTKNGSNICLTRTDRGWYCDNAGNVSFFPQAETCKVQSNRVFCDTMNSRTLPSEVNLCNVDIFNPKYDCKIMTSKTDVSS SVITSLGAIVSCYGKTKCTASNKNRGIIKTFSNGCDYVSNKGVDTVSVGNTLYVNKQEGKSLVVKGEPIINFYDPLVFPSDEFDASISQV NELINQSLAFINQSDELLSGSGSESQVRQQFSKDIEKLLNEQVNKEMQSSNLYMSMSSWSYTHSLDGAGLFLFDHAAEEYEHAKKLIIFLN ENNVPVQLTSISAPEHCFEGLTQIFQKAYEHEQHISESINNIVDHAIKSKDHATFNFLQWYVAEQHEEEVLFKDILDKIELIGNENHGLYL ADQYVKGIAKSRKS | 518 |
| RF8123 (RF8117 with C's at 69 and 212 knocked out for specific conjugation to ferritin CYS: C69V, C212V) | MELLILKANAITTILTAVTFCFASGQNITEEFYQSTCSAVSKGYLSALRTGWYTSVITIELSNIKENKCNGTDAKVLIKQELDKYKNAVT ELQLLMGSGNVGLGGAIASGVAVSKVLHLEGEVNKIKSALLSTNKAVVSLSNGVSVLTFKVLDLKNYIDKQLLPILNKQSVSISNPETVIE FQQKNNRLLEITREFSVNAGVTTPVSTYMLTNSELLSLINDMPITNDQKKLMSNNVQIVRQQSYSIMSIIKEEVLAYVVQLPLYGVIDTPC WKLHTSPLCTTNTKNGSNICLTRTDRGWYCDNAGNVSFFPQAETCKVQSNRVFCDTMNSRTLPSEVNLCNVDIFNPKYDCKIMTSKTDVSS SVITSLGAIVSCYGKTKCTASNKNRGIIKTFSNGCDYVSNKGVDTVSVGNTLYVNKQEGKSLVVKGEPIINFYDPLVFPSDEFDASISQV NEKINQSLAFINKSDELLSGSGSESQVRQQFSKDIEKLLNEQVNKEMQSSNLYMSMSSWSYTHSLDGAGLFLFDHAAEEYEHAKKLIIFLN ENNVPVQLTSISAPEHCFEGLTQIFQKAYEHEQHISESINNIVDHAIKSKDHATFNFLQWYVAEQHEEEVLFKDILDKIELIGNENHGLYL ADQYVKGIAKSRKS | 519 |
| RF8134: RF8122 like with K528N and K532N mutations to limit proteolysis instability | MELLILKANAITTILTAVTFCFASGQNITEEFYQSTCSAVSKGYLSALRTGWYTSVITIELSNIKENKCNGTDAKVLIKQELDKYKNAVT ELQLLMGSGNVGLGGAIASGVAVSKVLHLEGEVNKIKSALLSTNKAVVSLSNGVSVLTFKVLDLKNYIDKQLLPILNKQSCSISNPETVIE FQQKNNRLLEITREFSVNAGVTTPVSTYMLTNSELLSLINDMPITNDQKKLMSNNVQIVRQQSYSIMSIIKEEVLAYVVQLPLYGVIDTPC WKLHTSPLCTTNTKNGSNICLTRTDRGWYCDNAGNVSFFPQAETCKVQSNRVFCDTMNSRTLPSEVNLCNVDIFNPKYDCKIMTSKTDVSS SVITSLGAIVSCYGKTKCTASNKNRGIIKTFSNGCDYVSNKGVDTVSVGNTLYVNKQEGKSLVVKGEPIINFYDPLVFPSDEFDASISQV NELINQSLAFINQSDELLSGSGSESQVRQFSNDIENLLNEQVNKQEGNSLYMSMSSWSYTHSLDGAGLFLFDHAAEEYEHAKLLIIFLN ENNVPVQLTSISAPEHCFEGLTQIFQKAYEHEQHISESINNIVDHAIKSKDHATFNFLQWYVAEQHEEEVLFKDILDKIELIGNENHGLYL ADQYVKGIAKSRKS | 520 |
| RF8135: RF8122 like with K465N and K470N mutations to limit proteolysis instability | MELLILKANAITTILTAVTFCFASGQNITEEFYQSTCSAVSKGYLSALRTGWYTSVITIELSNIKENKCNGTDAKVLIKQELDKYKNAVT ELQLLMGSGNVGLGGAIASGVAVSKVLHLEGEVNKIKSALLSTNKAVVSLSNGVSVLTFKVLDLKNYIDKQLLPILNKQSCSISNPETVIE FQQKNNRLLEITREFSVNAGVTTPVSTYMLTNSELLSLINDMPITNDQKKLMSNNVQIVRQQSYSIMSIIKEEVLAYVVQLPLYGVIDTPC WKLHTSPLCTTNTKNGSNICLTRTDRGWYCDNAGNVSFFPQAETCKVQSNRVFCDTMNSRTLPSEVNLCNVDIFNPKYDCKIMTSKTDVSS SVITSLGAIVSCYGKTKCTASNKNRGIIKTFSNGCDYVSNKGVDTVSVGNTLYVNKQEGKSLVVNGEPIINFYDPLVFPSDEFDASISQV NELINQSLAFINQSDELLSGSGSESQVRQQFSKDIEKLLNEQVNKEMQSSNLYMSMSSWSYTHSLDGAGLFLFDHAAEEYEHAKLLIIFLN ENNVPVQLTSISAPEHCFEGLTQIFQKAYEHEQHISESINNIVDHAIKSKDHATFNFLQWYVAEQHEEEVLFKDILDKIELIGNENHGLYL ADQYVKGIAKSRKS | 521 |
| RF8136: RF8122 like with K465N, K470N, K528N and K532N | MELLILKANAITTILTAVTFCFASGQNITEEFYQSTCSAVSKGYLSALRTGWYTSVITIELSNIKENKCNGTDAKVLIKQELDKYKNAVT ELQLLMGSGNVGLGGAIASGVAVSKVLHLEGEVNKIKSALLSTNKAVVSLSNGVSVLTFKVLDLKNYIDKQLLPILNKQSCSISNPETVIE | 522 |

TABLE 1-continued (Sequence Table): Description of the Sequences

| Description | Sequences | SEQ ID NO |
|---|---|---|
| mutations to limit proteolysis instability | FQQKNNRLLEITREFSVNAGVTPVSTYMLTNSELLSLINDMPITNDQKKLMSNNVQIVRQQSYSIMSIIKEEVLAYVVQLPLYGVIDTPC WKLHTSPLCTTNTKNGSNICLRTRDRGWYCDNAGNVSFFPQAETCKVQSNRVFCDTMNSRTLPSEVNLCNVDIFNPKYDCKIMTSKTDVSS SVITSLGAIVSCYGKTKCTASNKNRGIIKTFSNGCDYVSNKGVDTVSVGNTLYYVNKQEGNSLYVNGEPIINFYDPLVPSDEFDASISQV NELINQSLAFINQSDELLSGSGSESQVRQQFSNDIENLLNEQVNKEMQSSNLYMSMSSWSYTHSLDGAGLFLFDHAAEEYEHAKKLIIFLN ENNVPVQLTSISAPEHCFEGLTQIFQKAYEHEQHISESINNIVDHAIKSKDHATFNFLQWYVAEQHEEEVLFKDILDKIELIGNENHGLYL ADQYVKGIAKSRKS | 523 |
| RF8140: RF8122 with R523Q in the bull frog linker mutated to prevent potential proteolysis in CHO cells | MELLILKANAITTLLTAVTFCFASGQNITEEFYQSTCSAVSKGYLSALRTGWYTSVITIELSNIKENKCNGTDAKVKLIKQELDKYKNAVT ELQLLMQSGNVGLGGAIASGVAVSKVLHLEGEVNKIKSALLSTNKAVVSLSNGVYLTPKVLDLKNYIDKQLLPILNKQSCSISNPETVIE FQQKNNRLLEITREFSVNAGVTPVSTYMLTNSELLSLINDMPITNDQKKLMSNNVQIVRQQSYSIMSIIKEEVLAYVVQLPLYGVIDTPC WKLHTSPLCTTNTKNGSNICLRTRDRGWYCDNAGNVSFFPQAETCKVQSNRVFCDTMNSRTLPSEVNLCNVDIFNPKYDCKIMTSKTDVSS SVITSLGAIVSCYGKTKCTASNKNRGIIKTFSNGCDYVSNKGVDTVSVGNTLYYVNKQEGKSLYVKGEPIINFYDPLVPSDEFDASISQV NELINQSLAFINQSDELLSGSGSGSEQVQQQFSDIEKLLNEQVNKEMQSSNLYMSMSSWSYTHSLDGAGLFLFDHAAEEYEHAKLLIIFLN ENNVPVQLTSISAPEHCFEGLTQIFQKAYEHEQHISESINNIVDHAIKSKDHATFNFLQWYVAEQHEEEVLFKDILDKIELIGNENHGLYL ADQYVKGIAKSRKS | 524 |
| Post-F, benchmark control molecule | MELLILKANAITTLLTAVTFCFASGQNITEEFYQSTCSAVSKGYLSALRTGWYTSVITIELSNIKENKCNGTDAKVKLIKQELDKYKNAVT ELQLLMQSTPATNNRARRELPRFMNYTLNNAKKTNVTLSKKRKRRAIASGVAVSKVLHLEGEVNKIKSALLSTNKAVVSLSNGVSVLTSKV LDLKNYIDKQLLPIVNKQSCSISNIETVIEFQQKNNRLLEITREFSVNAGVTPVSTYMLTNSELLSLINDMPITNDQKKLMSNNVQIVRQ QSYSIMSIIKEEVLAYVVQLPLYGVIDTPCWKLHTSPLCTTNTKEGSNICLRTRDRGWYCDNAGSVSFFPQAETCKVQSNRVFCDTMNSLT LPSEVNLCNVDIFNPKYDPLVPSDEFDASISQVNEKINQSLAFIRKSDELLGLEVLFQGPHHHHHHSAWSHPQFEK | 525 |
| DS-CAV1, positive control molecule | MELLILKANAITTLLTAVTFCFASGQNITEEFYQSTCSAVSKGYLSALRTGWYTSVITIELSNIKENKCNGTDAKVKLIKQELDKYKNAVT ELQLLMQSTPATNNRARRELPRFMNYTLNNAKKTNVTLSKKRKRRFLGFLLGVGSAIASGVAVCKVLHLEGEVNKIKSALLSTNKAVVSLS NGVSVLTFKVLDLKNYIDKQLLPILNKQSCSISNIETVIEFQQKNNRLTNVTLSPLCTTNTKEGSNICLRTRDRGWYCDNAGSVSFFPQAETCKVQSNR MSNNVQIVRQQSYSIMCIIKEEVLAYVVQLPLYGVIDTPCWKLHTSPLCTTNTKEGSNICLRTRDRGWYCDNAGSVSFFPQAETCKVQSNR VFCDTMNSLTLPSEVNLCNVDIFNPKYDCKIMTSKTDVSSSVITSLGAIVSCYGKTKCTASNKNRGIIKTFSNGCDYVSNKGVDTVSVGNT LYYVNKQEGKSLYVKGEPIINFYDPLVPSDEFDASISQVNEKINQSLAFIRKSDELLSGSSGSSGGSDIIKLLNEQVNKEMQSSNLYMS MSSWCYTHSLDGAGLFLFDHAAEEYEHAKKLIIFLNENNVPVQLTSISAPEHKFEGLTQIFQKAYEHEQHISESINNIVDHAIKSKDHATF NFLQWYVAEQHEEEVLFKDILGNENHGLYLADQYVKGIAKSRKSGS | 526 |
| Wild-type, Native RSV F (A2 strain) | MELLILKANAITTLLTAVTFCFASGQNITEEFYQSTCSAVSKGYLSALRT TABLE 1-continued (Sequence Table): Description of the Sequences

| Description | Sequences | SEQ ID NO |
| --- | --- | --- |
| RSV G peptide A2 for conjugation with N-terminal Azido linker and flanking glutamates (aa 151-193) | Azido-PEG4-SGGSSGSSEEEGGSRQNKPNNDFHFEVFNFVPCSICSNNPTCWAICKRIPNKKEEE | 529 |
| CpG oligodeoxy-nucleotide (asterisks indicate phosphorothioate linkages) | T*G*A*C*T*G*T*G*A*A*C*G*T*T*C*G*A*G*A*T*G*A | 530 |
| Replacement sequence in RF8117 substituted for positions 98-144 of SEQ ID NO: 526 (wild-type RSV F) | GSGNVGL | 531 |
| Monobasic mutation sequence | PQRET | 532 |
| Linker | SGSGS | 533 |
| CpG oligonucleotide | tgactgtgaacgttcgagatg | 534 |
| CpG oligonucleotide | tccatgacgttcctgacgtt | 535 |
| RSV Gcc (central conserved region) A2 strain res 151-193 | RQNKPPNKPNNDFHFEVFNFVPCSICSNNPTCWAICKRIPNKK | 536 |
| RSV Gcc (central conserved region) B1 strain | RKNPPKKPKDDYHFEVFNFVPCSICGNNQLCKSICKTIPNKK | 537 |

EXAMPLES

The following examples are provided to illustrate certain disclosed embodiments and are not to be construed as limiting the scope of this disclosure in any way.

Example 1. Preparation of OspA-Ferritin Antigenic Polypeptides

Antigenic polypeptides comprising OspA and ferritin were generated.

OspA was synthesized by Genescript from the following sequences: *Borrelia burgdorferi* strain B31 (Serotype 1) NBCI sequence ID WP_010890378.1, *Borrelia afzelii* strain PKO (Serotype 2) NCBI sequence: WP_011703777.1, *Borrelia garinii* strain PBr (Serotype 3) GenBank: CAA56549.1, *Borrelia bavariensis* (Serotype 4) NCBI sequence WP_011187157.1, *Borrelia garinii* (Serotype 5) GenBank CAA59727.1, *Borrelia garinii* (serotype 6) GenBank: CAA45010.1, and *Borrelia garinii* (Serotype 7) GenBank CAA56547.1. The *H. pylori* ferritin with an inserted N-terminal bull frog ferritin sequence was synthesized by Genescript, in which the bull frog ferritin sequence is similar to that of a previous study (see Kanekiyo, M., et al., Cell 162(5):1090-100 (2015)). The pet21a vector was used to express both His-tagged OspA and OspA-ferritin nanoparticles in *E. coli*. A mammalian expression vector similar to that used previously was used for expression in Expi293 cells (see Xu, L., et al., Science 358(6359):85-90 (2017)).

OspA-ferritin nanoparticles were created by genetically fusing the ectodomain of OspA to the amino-terminus of ferritin to generate an antigenic polypeptide (FIG. 1A). OspA is a 31-kDa lipoprotein with an extended β-sheet structure made up of 21 consecutive antiparallel β-strands with only one carboxy-terminal α-helix (FIG. 1B) (see Kitahara, R., et al., Biophys J 102(4):916-26 (2012)). The carboxy-terminus of OspA also has an unusually large cavity (~200Å) that represented a site compatible for linkage to ferritin using a glycine-serine sequence (FIG. 1B). The 24 subunits of ferritin assemble spontaneously into a hollow spherical nanoparticle (FIG. 1C). The ferritin used in this study contains the amino-terminal sequence of bullfrog ferritin fused to *Helicobacter pylori* ferritin to create a chimera minimally related to human ferritin (see Kanekiyo 2015). The amino-terminal bullfrog ferritin sequence projects radially from the nanoparticle core (see Trikha, J., et al. J Mol Biol 248(5):949-67 (1995)), facilitating the presentation of OspA evenly on the nanoparticle surface.

Three additional changes were made to the ferritin structure to improve its functionality: N19Q, C31S and S111C. The N19Q substitution removed a potential amino-terminal glycosylation site. The S111C substitution introduces a surface-exposed cysteine on the ferritin that can be used to conjugate adjuvants with, for example, click chemistry. Finally, cysteine 31 was modified to serine so that only one cysteine would be modified by conjugation. Display of OspA on the nanoparticle surface provides a 24-mer antigenic nanoparticle (FIG. 1D).

For purification from *E. coli*, we used BL21 Star (DE3) (Invitrogen Cat #C601003). We induced the protein with 100 μM IPTG overnight at 16° C. The cell pellet was lysed using sonication in Tris buffer pH 8, 50 mM NaCl. The filter sterilized supernatant was purified on an anion exchange column (HiTrap Q HP, GE), by collecting OspA-ferritin from the flow-through. Endotoxin was then removed by a 1% Triton X114 extraction that was repeated 6 times. The aqueous phase was then concentrated using an Amicon 100 MW cutoff filter (Millipore Cat #UFC910096) and nanoparticles were then further purified on a 120 ml Superose 6 preparatory SEC column at 4° C. For purification from mammalian cell culture, Expi293 cells were transfected with plasmid DNA using FectoPRO transfection Reagent (Polyplus, Cat #116-100) per manufacturer's instructions. Transfected cells were cultured on day 5 and the supernatant was collected and filtered. Endotoxin-free protocols were followed using endotoxin-free reagents and glassware. Q sepharose Fast flow beads (GE, Cat #17-0510-01) were prepared with 50 mM Tris pH7, 50 mM NaCl and applied to the filter-sterilized supernatant by gravity flow. The flow-through was collected and concentrated to 4 ml using Amicon 100 MW cutoff filter. Nanoparticles were then further purified on a 120 ml Superose 6 preparatory SEC column at room temperature.

For purification of $His_6$-tagged (SEQ ID NO: 442) OspA, serotype 1, 4, 5, and 7 OspA were purified from *E. coli* BL21 (DE3) (Invitrogen Cat #C600003), and serotype 2 and 3 were purified from Expi293 cells. These constructs lacked the transmembrane domain, comprised a C-terminal $His_6$-tag (SEQ ID NO: 442), and were otherwise wild-type. For *E. coli* purification, protein was induced at 500 μM IPTG for 5 hours and cells were pelleted and frozen at −20° C. Pellet was resuspended in 1% Triton in TBS buffer with Complete Protease Inhibitor (Sigma-Aldrich, Cat #11697498001) and sonicated to lyse cells. The supernatant was filter sterilized. For mammalian cell culture, the supernatant was collected at day 5 after transfection and filter sterilized. The supernatant was run on a GE HiTrap HP 5 ml column (Cat #17-5248-02) attached to an AKTA Pure FPLC. The column was washed and loaded and washed again with 20 mM imidizole in TBS. Final protein was eluted with 250 mM imidizole in TBS.

Figure 2A:
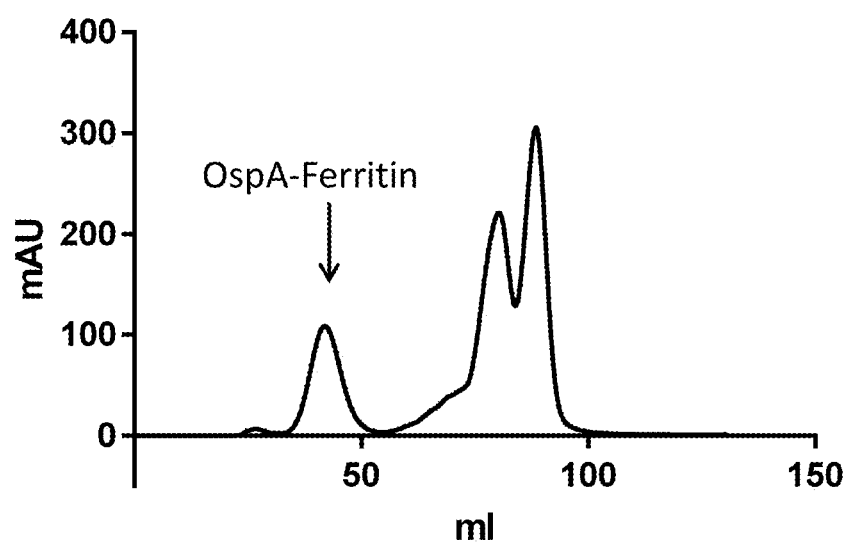
FIGS. 2A-2D show expression and purification of an exemplary OspA-Ferritin.
Figure 2B:
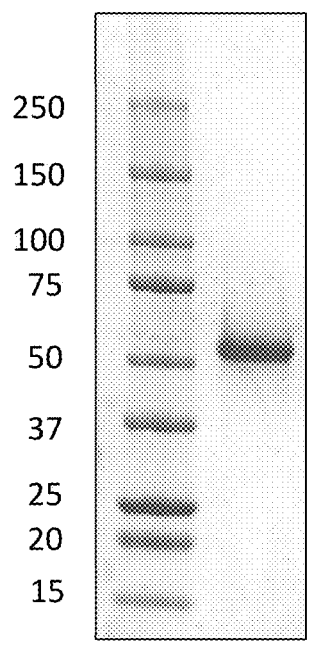

OspA serotype 1 was expressed from *B. burgdorferi* strain B31 fused to ferritin in a transformed human renal epithelial cell line, Expi293 (FIGS. 2A-2D; SEQ ID NO: 52). The formation of the nanoparticles and the purity of the protein were confirmed by size exclusion column chromatography (SEC) and SDS-PAGE (FIGS. 2A and 2B, respectively). SEC analysis revealed a single symmetrical peak of the expected retention time (FIG. 2A).

Figure 2C:
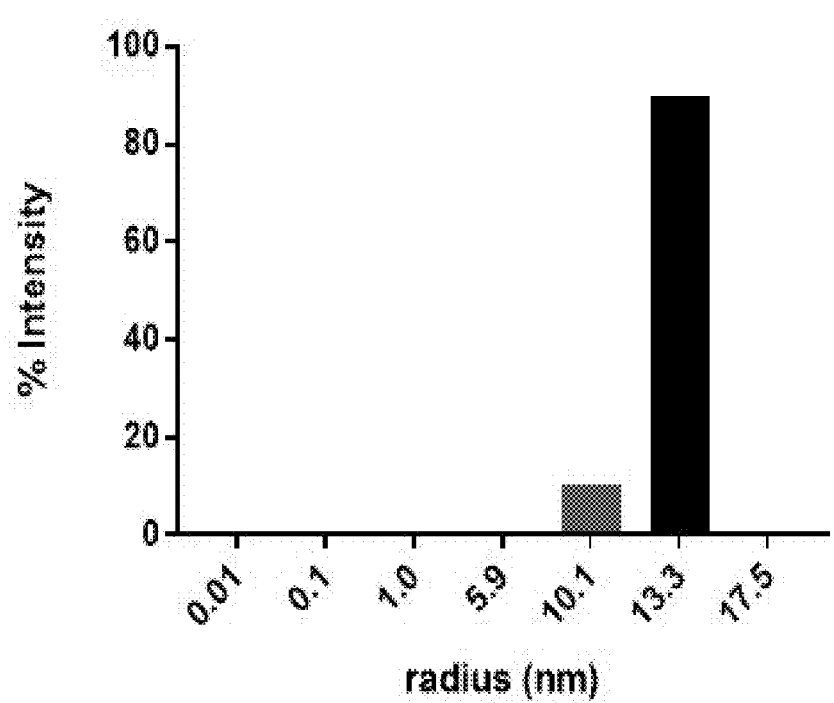

Dynamic light scattering (DLS) analysis was also performed. Purified nanoparticles were loaded into a black 384 well plate with a clear bottom (Corning, Cat #3540) at a concentration ~0.4 μg/ml. Samples were read with a DynaPro plater Reader II (Wyatt) at a control temperature of 25° C. DLS documented a particle size of 13 nm with low polydispersity (7.4%) that is pure and without aggregates (FIG. 2C). Elimination of the transmembrane domain of OspA (aa 1-25) that contains the lipidation site improved the ease of purification. The OspA sequence contains four potential amino-linked glycosylation sites, and OspA-ferritin purified from mammalian cells migrated at a higher molecular weight consistent with the addition of glycans (FIG. 2B).

Figure 2D:
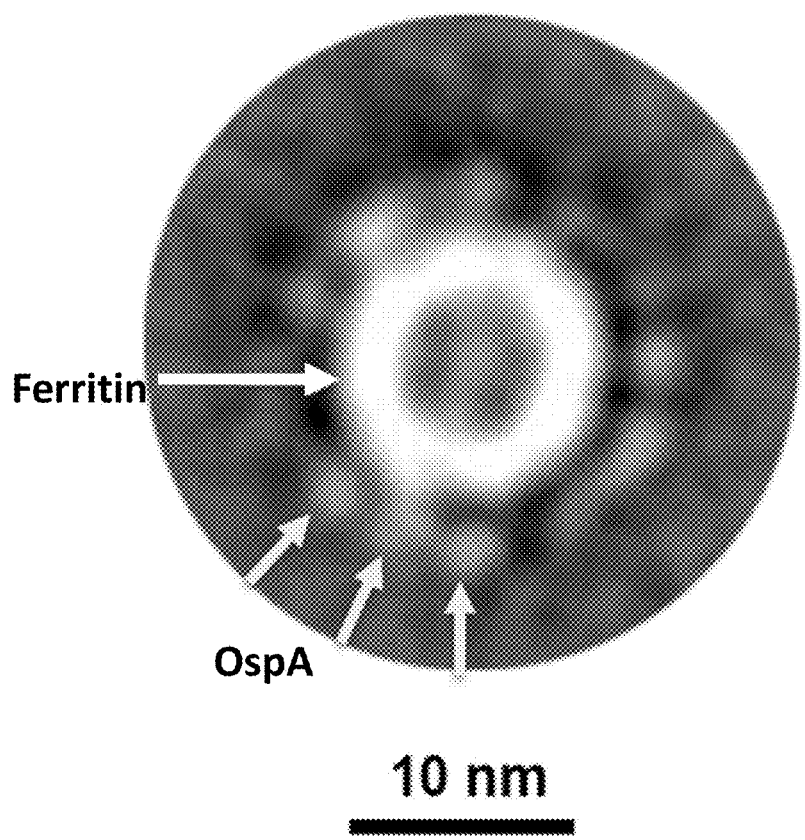

Transmission electron microscopy negative stain imaging and 2D class averaging analysis was performed on the OspA-ferritin nanoparticles (FIG. 2D). A sample of OspA-ferritin nanoparticles was diluted 300-fold in 1×TBS and imaged over a layer of continuous carbon supported by nitro-cellulose on a 400-mesh copper grid. The grids were prepared by applying 3 μl of sample suspension to a cleaned grid, blotting away with filter paper, and immediately stained with uranyl formate. Electron microscopy was performed using an FEI Tecnai T12 electron microscope equipped with an FEI Eagle 4k×4K CCD camera. High magnification images were acquired at magnification of 67,000 (0.16 nm/pixel). The images were acquired at a nominal underfocus of −1.9 μm to −0.8 μm and electron doses of ~30 e⁻/Å². Individual particles in the 67,000× high magnification images were selected using automated picking protocols (see Lander, G. C., et al., J Struct Biol, 166(1):95-102 (2009)). A reference-free alignment strategy was used based on the XMIPP processing package (see Sorzano, C. O., et al., J Struct Biol 148(2): p. 194-204 (2004)). Algorithms in this package align the selected particles and sort them into self-similar groups or classes.

The ferritin nanoparticle appeared as a strong circular density with a hollow center in the middle (FIG. 2D). Each nanoparticle was surrounded by numerous, short, uniform spikes of OspA that appear slightly oblong in shape. The particles have an overall diameter ranging from ~194-220 Å, with the ferritin core of 125 Å diameter. The spikes extended uniformly in size, shape and orientation from the particle surface up to 45 Å in length. The OspA spikes were ~30 Å in width and tapered to minimal density at the glycine-serine linker of ferritin.

Figure 5A:
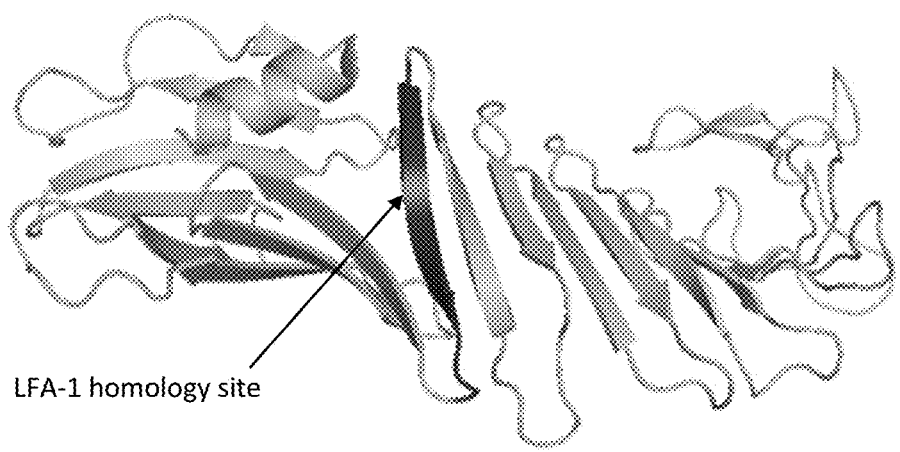
FIGS. 5A-5C present information regarding exemplary OspA-Ferritin, wherein the OspA polypeptide is modified at an epitope of OspA serotype 1 that has homology with a fragment of the sequence of human leukocyte function-associated antigen-1 (hLFA-1).
Figure 5B:
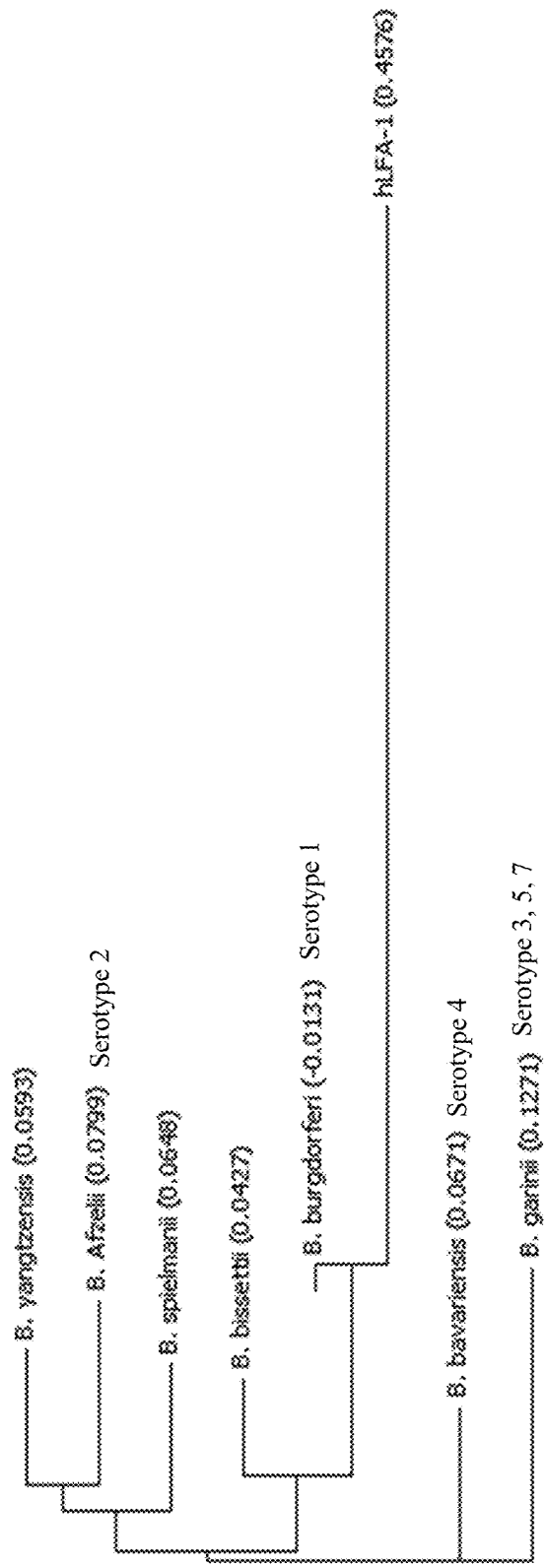
Figures 5C, 5D:
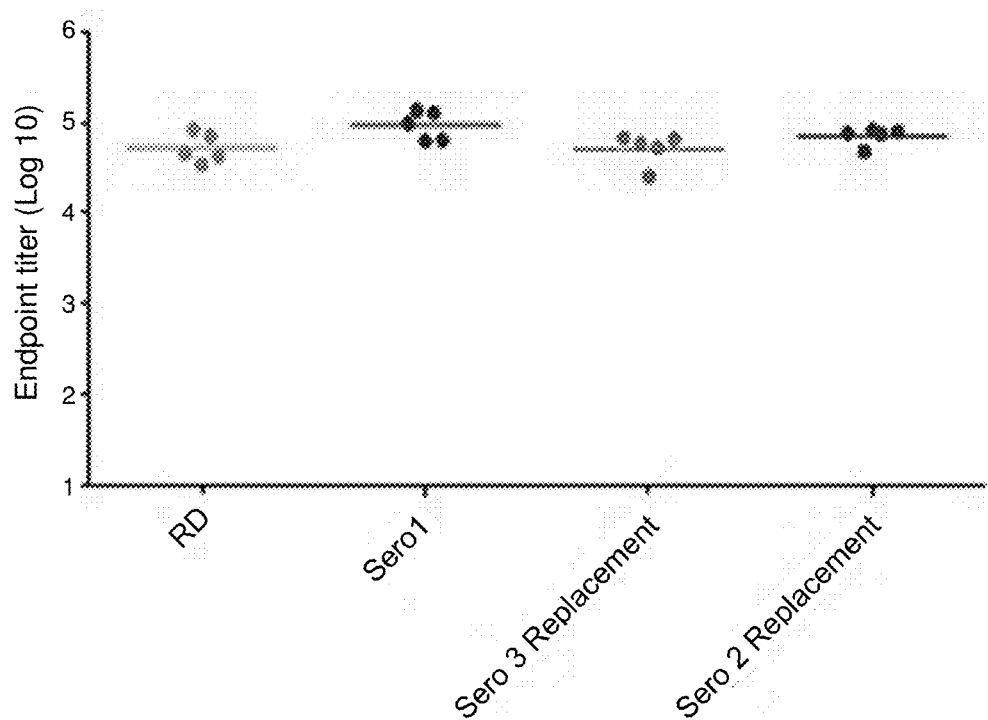

When the LYMErix™ vaccine was discontinued in 2002, the concern was raised that the vaccine contained an epitope (amino acids 165-173 of SEQ ID NO: 83) with homology to a nonapeptide segment (SEQ ID NO: 78) from the human leukocyte function-associated antigen-1 (hLFA-1, see Gross, D. M., et al., Science 281(5377): p. 703-6 (1998)) (FIG. 5A). Amino acids 165-173 of SEQ ID NO: 83 are referred to as the hLFA-1 homology site. OspA serotype 1 is the only serotype that contains this sequence homology (FIG. 5B). To avoid any potential concerns related to this sequence, the hLFA-1 homology site was replaced with either the corresponding OspA serotype 2 (SEQ ID NO: 79) or serotype 3 (SEQ ID NO: 80) nonapeptide sequences, or point substitutions were introduced that reduced similarity to hLFA-1 and were intended to prevent the generation of antibodies that bind to hLFA-1 (RD2, SEQ ID NO: 81) (FIG. 5C). For the point substitutions, surface-exposed amino acids were substituted to reduce similarity to hLFA-1 while avoiding or minimizing destabilization of the β-sheet structure.

The immunogenicity of the hLFA-1 nanoparticles with a modified hLFA-1 homology site was tested in mice to compare the immune response relative to an OspA-ferritin nanoparticle without such modification (FIG. 5D). The antibody titers elicited by the nanoparticles with a modified hLFA-1 homology site were robust and not significantly different from the nanoparticles with an unmodified hLFA-1 homology site.

Figure 4:
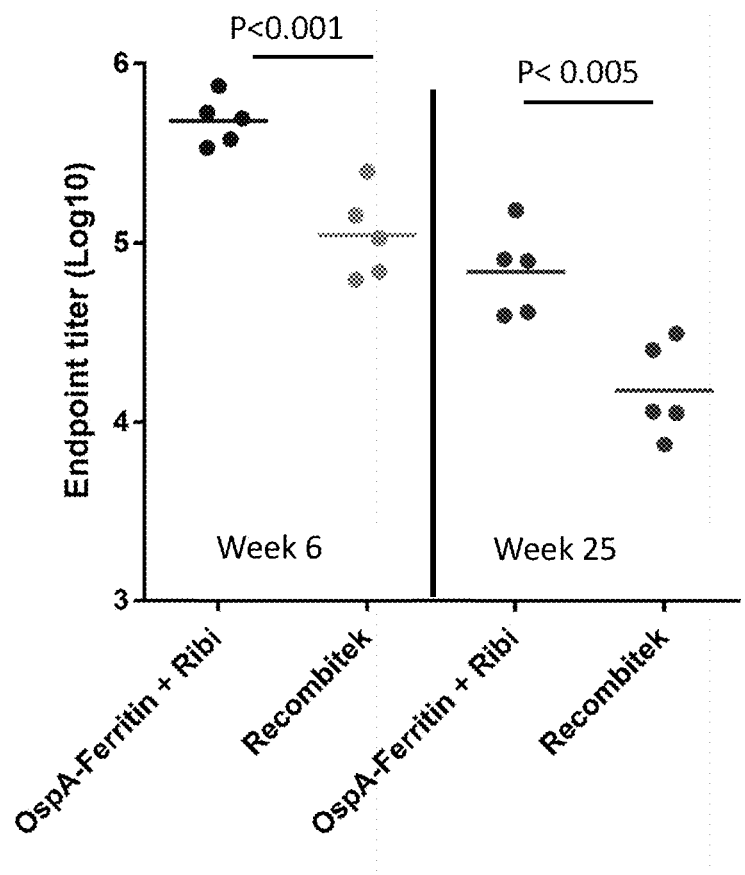
FIG. 4 shows comparison of immunogenicity and duration of exemplary Serotype 1 OspA-Ferritin nanoparticles to RECOMBITEK® Lyme (liquid suspension of purified Outer surface protein A (OspA) of *Borrelia burgdorferi*). C3H mice (n=5) were immunized intramuscularly with 1 μg of the OspA-Ferritin+Ribi adjuvant (Sigma adjuvant system Cat #S6322-1vl) or RECOMBITEK® Lyme at week 0 and week 4. Antibody response was assessed by measuring endpoint titers via ELISA 2 weeks after the 2nd immunization (week 6) and 21 weeks after $2^{nd}$ immunization (week 25) with each composition.

Example 2. Characterization of Immunogenicity of OspA-Ferritin Nanoparticles To assess the immunogenicity of OspA-ferritin nanoparticles, C3H mice were immunized twice with serotype 1 OspA-ferritin nanoparticles in the presence of Ribi adjuvant or RECOMBITEK® Lyme (liquid suspension of purified Outer surface protein A (OspA) of *Borrelia burgdorferi*), a canine vaccine in which the OspA is full-length, lipidated, recombinant, and of serotype 1 (FIG. 4). C3H/HeN mice were vaccinated intramuscularly at week zero and week 4. ELISAs were run on serum from 2 weeks post 2$^{nd}$ dose. Ribi (Sigma adjuvant system Cat #56322-1vl) was resuspended in 1 ml of PBS and vortexed for 1 minute and then added in equal volume to antigen prior to immunization.

The antibody response was determined using an enzyme-linked immunosorbent assay (ELISA) to recombinant OspA. Briefly, 96-well plates were coated with 1 μg/ml of OspA-His diluted in PBS and incubated overnight at 4° C. The OspA-His was removed and the plates were blocked with 5% skim milk dissolved in PBST. After removing the blocking reagent, the primary serum samples were added after being serially diluted in PBST. The primary samples were added in equal volume to blocking solution for a final 50% blocking solution concentration. After a 1-hour incubation, the plates were washed with PBST and incubated with Goat anti-mouse IgG, HRP-linked secondary antibody (1:5,000 dilution in blocking solution) for 1 hour at room temperature. The secondary antibody was aspirated and washed and the plates were incubated with Sure Blue TMB peroxidase substrate (KPL, Gaithersburg, MD) followed by equal volume of stop solution (0.5 N sulfuric acid). Absorbance was measured at 450 nm.

Immunization with OspA-ferritin induced endpoint titers 4.4-fold higher than RECOMBITEK® Lyme at week six ($p<0.001$). The antibody titer at week 25 is also significantly higher than RECOMBITEK® Lyme ($p<0.005$) (FIG. 4).

Example 3. Glycosylation Mutants; Evaluation of Efficacy

To evaluate the protective efficacy of this OspA-ferritin, a challenge model was used in which immunized or control mice were infected by ticks carrying *B. burgdorferi* (see Rosa, P. A., et al. Nat Rev Microbiol 3(2): p. 129-43 (2005)).

Figure 13:
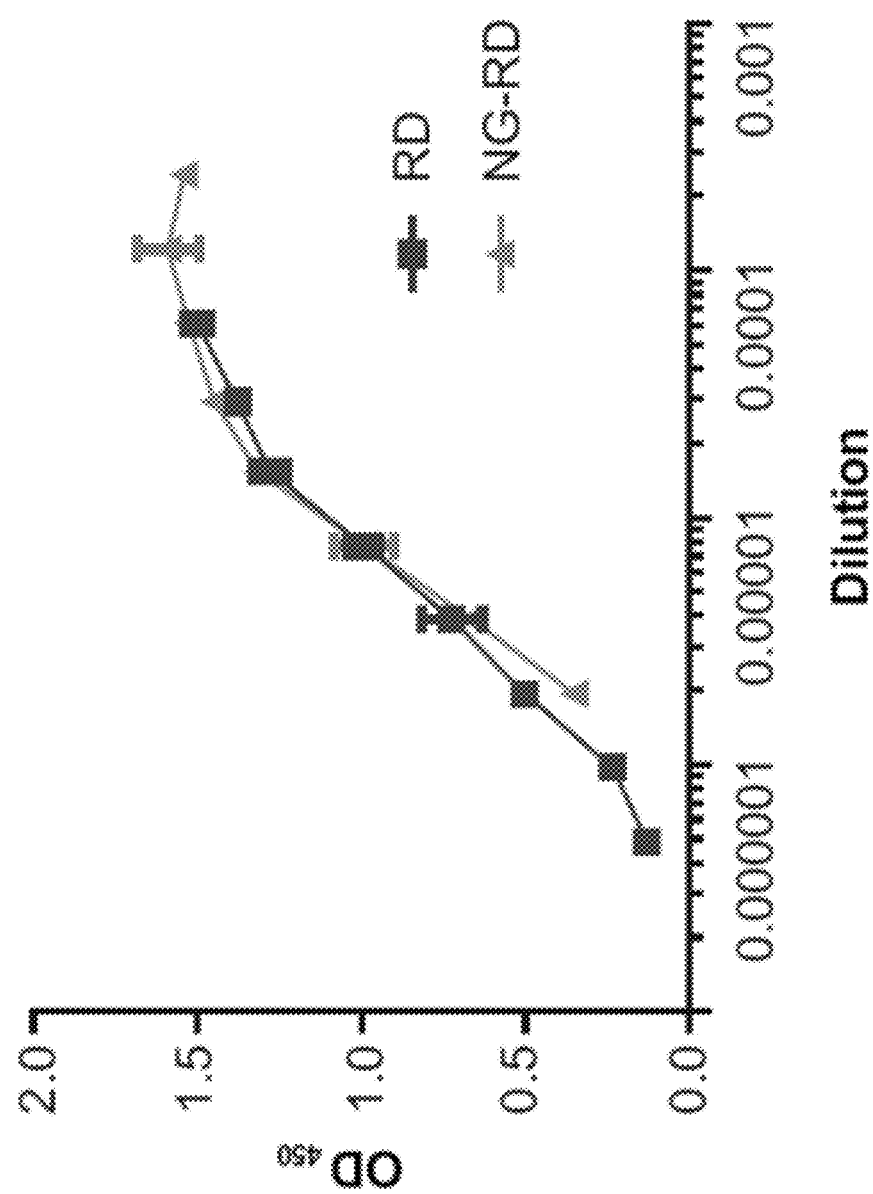
FIG. 13 shows antibody response in mice to non-glycosylated mutant OspA-ferritin (NG-RD) as compared to a glycosylated counterpart (RD) measured by ELISA across a dilution series as shown. RD=SEQ ID NO: 52. NG-RD=SEQ ID NO: 53. Mice were vaccinated with 1 µg doses at week zero and week 4.

C3H/HeN mice were vaccinated intramuscularly with 1 μg of either OspA-ferritin nanoparticle mixed with AddaVax™ 1:1 or 1 μg of ferritin nanoparticle. Mice were vaccinated at week zero and week 4. A serotype 1 OspA-ferritin nanoparticle with rationally designed modifications to the hLFA-1 homology site and modifications to remove all potential N-glycosylation sites (SEQ ID NO: 53) was used to immunize mice since natural bacterially expressed OspA is not glycosylated at these positions. The sequence contained the following N>Q substitutions to prevent glycosylation: N71Q, N190Q, N202Q, and N251Q. Its immunogenicity was similar to the glycosylated nanoparticle (FIG. 13).

Figure 14:
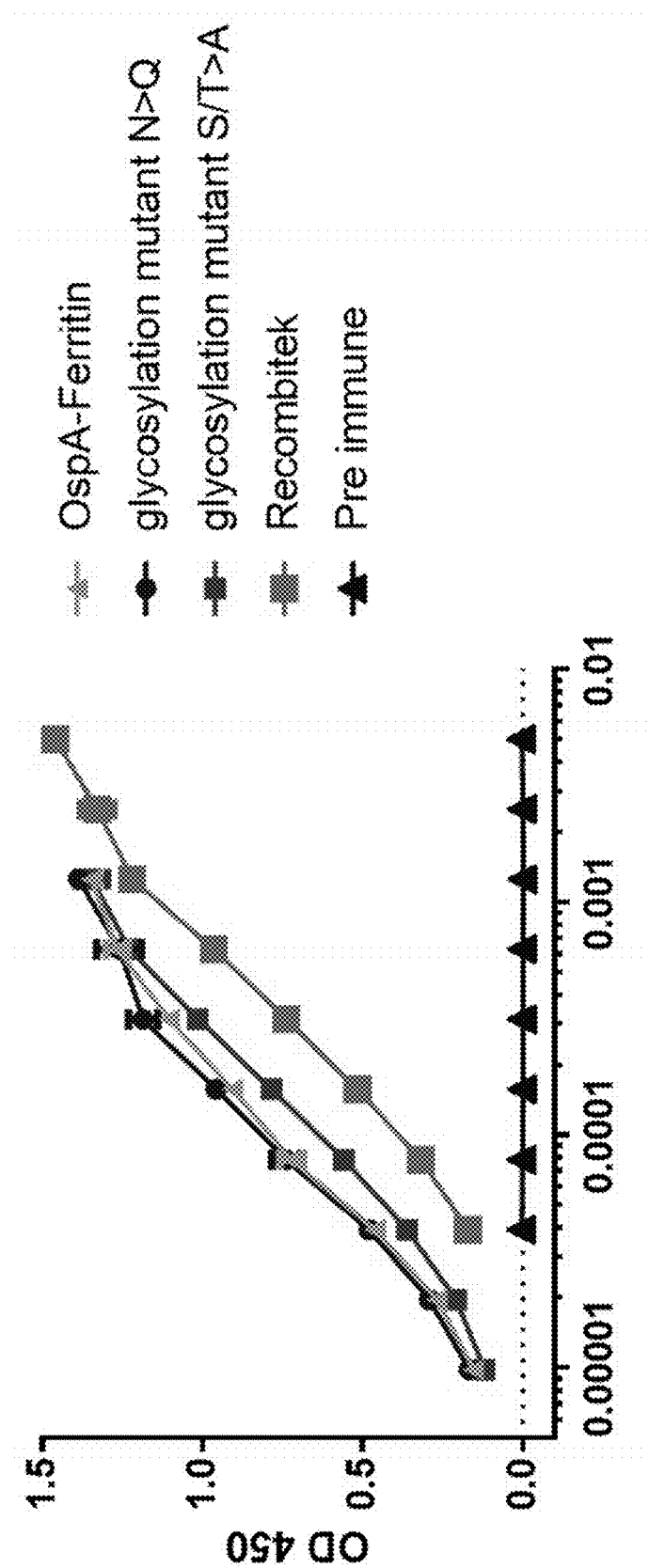
FIG. 14 shows antibody response in mice to OspA-ferritin (SEQ ID NO: 52). OspA-ferritin glycosylation mutant N>Q (SEQ ID NO: 53), and glycosylation mutant S/T>A (SEQ ID NO: 63) compared to RECOMBITEK® Lyme and negative (Pre immune) controls, measured by ELISA across a dilution series as shown.

Glycosylation mutants of OspA-ferritin were also tested when the glycosylation site serine/threonines were mutated to an alanine (SEQ ID NO: 63). Both this construct and the N>Q construct discussed above gave a strong immune response as compared to the OspA-ferritin with wild-type glycosylation sites (SEQ ID NO: 52) and were superior to the RECOMBITEK® Lyme control (FIG. 14).

In a further experiment to evaluate the protective efficacy of OspA-ferritin nanoparticles in a tick challenge model, *Ixodes scapularis* tick larvae were obtained from National Tick Research and Education Center, Oklahoma State University (Stillwater, OK). *B. burgdorferi*-infected nymphs were generated by allowing uninfected larvae to feed to repletion on *B. burgdorferi* strain N40-infected SCID mice. The engorged larvae were collected and allowed to molt into nymphs in 4-6 weeks at room temperature and high relative humidity. Prevalence of *B. burgdorferi* infection in fed larvae was determined by culture of a portion of the recovered ticks from each batch.

Mice were immunized twice with 1 μg doses of OspA-ferritin (SEQ ID NO: 53) with AddaVax™ adjuvant or control ferritin at week 0 and week 4, and a comparison group was immunized in parallel with RECOMBITEK® Lyme. Mice were challenged at week 6 (i.e., 2 weeks after the second vaccination dose), by allowing 5 to 6 *B. burgdorferi* infected nymphal ticks to feed to repletion. The fed nymphs were collected and assayed for *B. burgdorferi* infection by culture in BSK media. Two weeks after challenge, the mice were sacrificed and assayed for *B. burgdorferi* infection by culture of the ear, ankle and heart culture. Presence of *B. burgdorferi* was determined by observing the cultures by dark field microscopy. A mouse was defined as infected with *B. burgdorferi* if one or more organ cultures were found positive by darkfield microscopy. Negative cultures were also tested by PCR specific to *B. burgdorferi*.

Mice were sacrificed two weeks later. Tissue samples from the heart, ankle and ear were cultured in BSK media with antibiotics for *B. burgdorferi* for 6 wks. Negative samples were tested by PCR for the presence of *B. burgdorferi*. All negative cultures were also PCR negative. Protection was calculated as a percentage of uninfected mice.

The composition comprising OspA-ferritin and AddaVax™ adjuvant showed no infection (0/4) in contrast to negative control ferritin, where 4 of 5 animals were infected (Table 5; p<0.01).

TABLE 5

Protective efficacy of OspA-ferritin nanoparticles

| Antigen | Mice/group | # mice infected | % Infected |
| --- | --- | --- | --- |
| Control particle | 5 | 4 | 80 |
| OspA-ferritin + AddaVax ™ | 4 | 0 | 0 |
| RECOMBITEK ® Lyme | 4 | 0 | 0 |

Figure 6A:
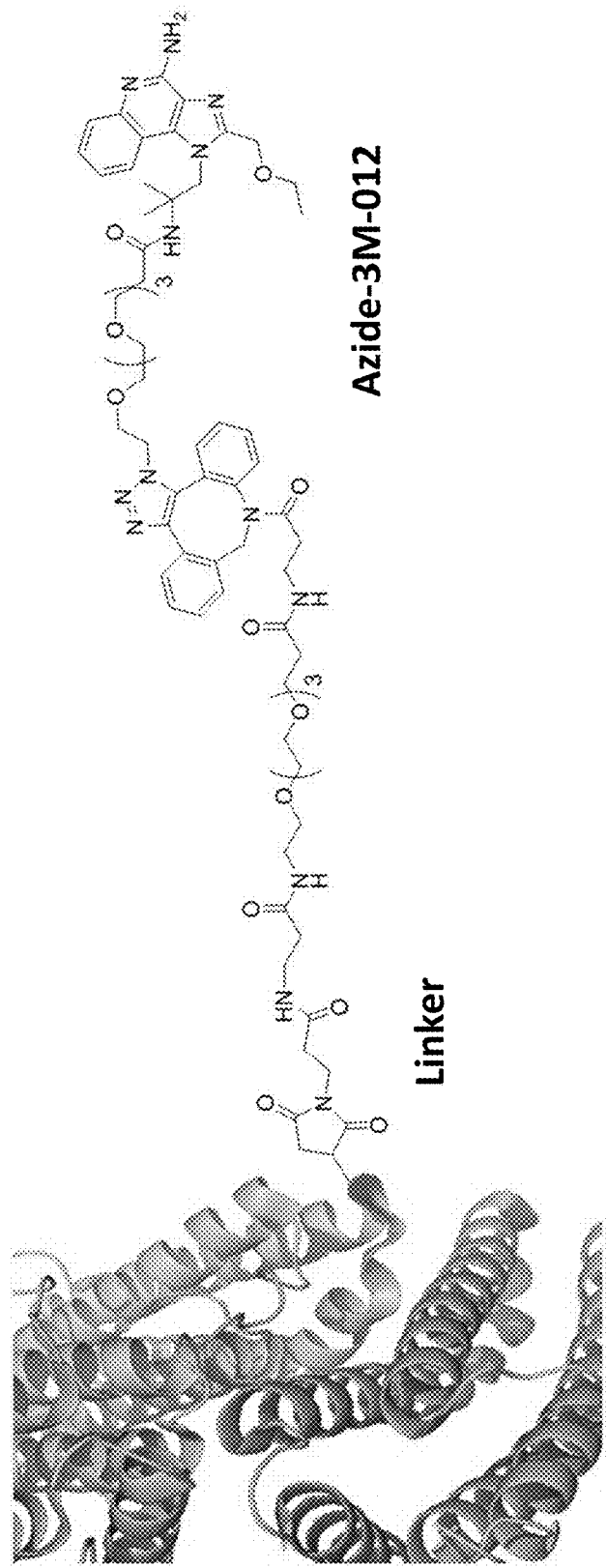
Figure 7A:
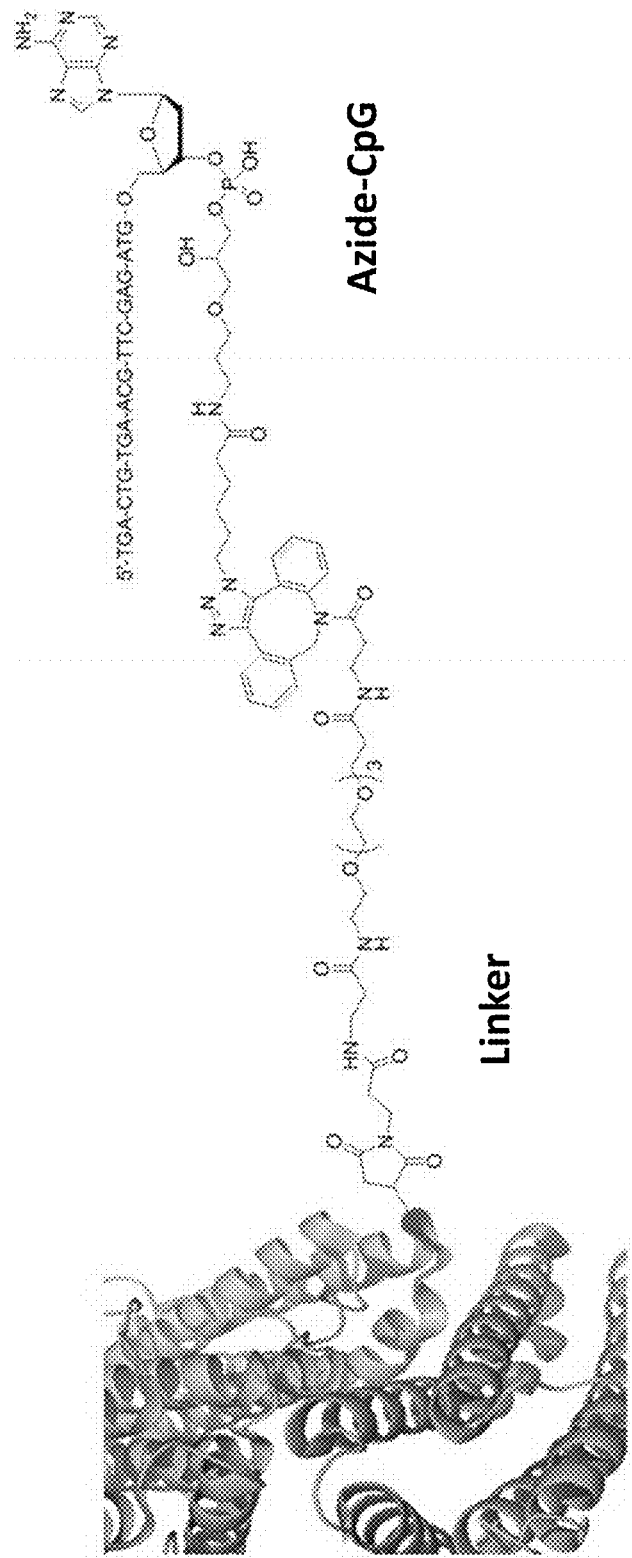

Example 4. Evaluation of Efficacy of OspA-Ferritin Conjugated to Immune-Stimulatory Moieties A self-adjuvanting construct was generated by engineering a cysteine (S111C) on the surface of the ferritin nanoparticle that allows direct conjugation of immune-stimulatory moieties such as TLR agonists (FIG. 6A) or CpG (SEQ ID NO: 210; ISS-1018, FIG. 7A) through click chemistry. The procedure for direct conjugation was as follows: Mammalian produced material was reduced to remove cysteinylation with 10 mM TCEP (Amresco K831-10G) in 50 mM Tris pH8.5 for 1 hr. The protein was then dialyzed into 100 mM Tris pH 8, 50 mM NaCl to remove the TCEP. The *E. coli* produced material does not need to be reduced. A DBCO-PEG4-Malemide linker (Sigma-Aldrich cat #760676-5 mg) was resuspended at 5 mg/ml in DMSO. 2.5 mg of linker was added to 3 mg of protein in 10 ml volume (final DMSO concentration was 5%). Linker was incubated with the reduced protein for 30 minutes at room temperature. An Ambicon 100 MW cutoff filter concentrator was used to remove excess linker by buffer exchange (Millipore Cat #UFC910096). Azide-PEG4-3M-012 (synthesized in house) and Azide-CPG (ISS-1018 custom synthesized by IDT) were used for the final click chemistry step. 0.5 mg of adjuvant was added to 0.5 mg of protein for final conjugation step and incubated at 37° C. for 6 hours then 4° C. overnight. Excess adjuvant was removed by buffer exchange using an Ambicon 100 MW cutoff filter concentrator. Conjugation efficiency was confirmed by mass spectrometry for 3M-012 and SDS-PAGE analysis for CPG.

Figure 7B:
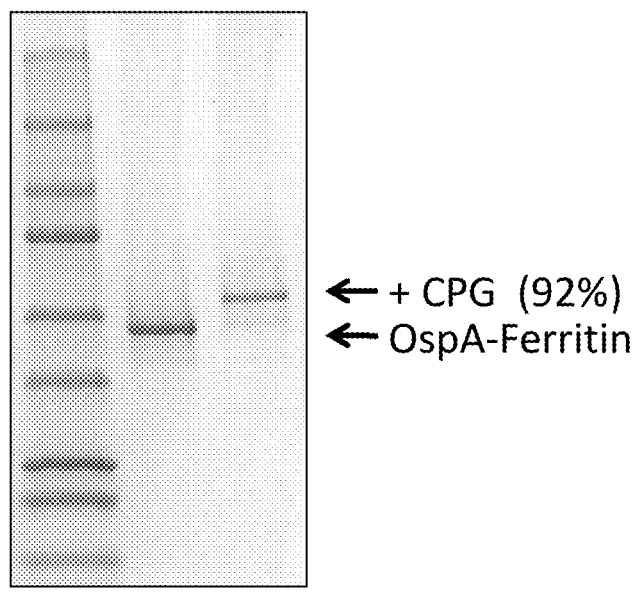
Figure 12:
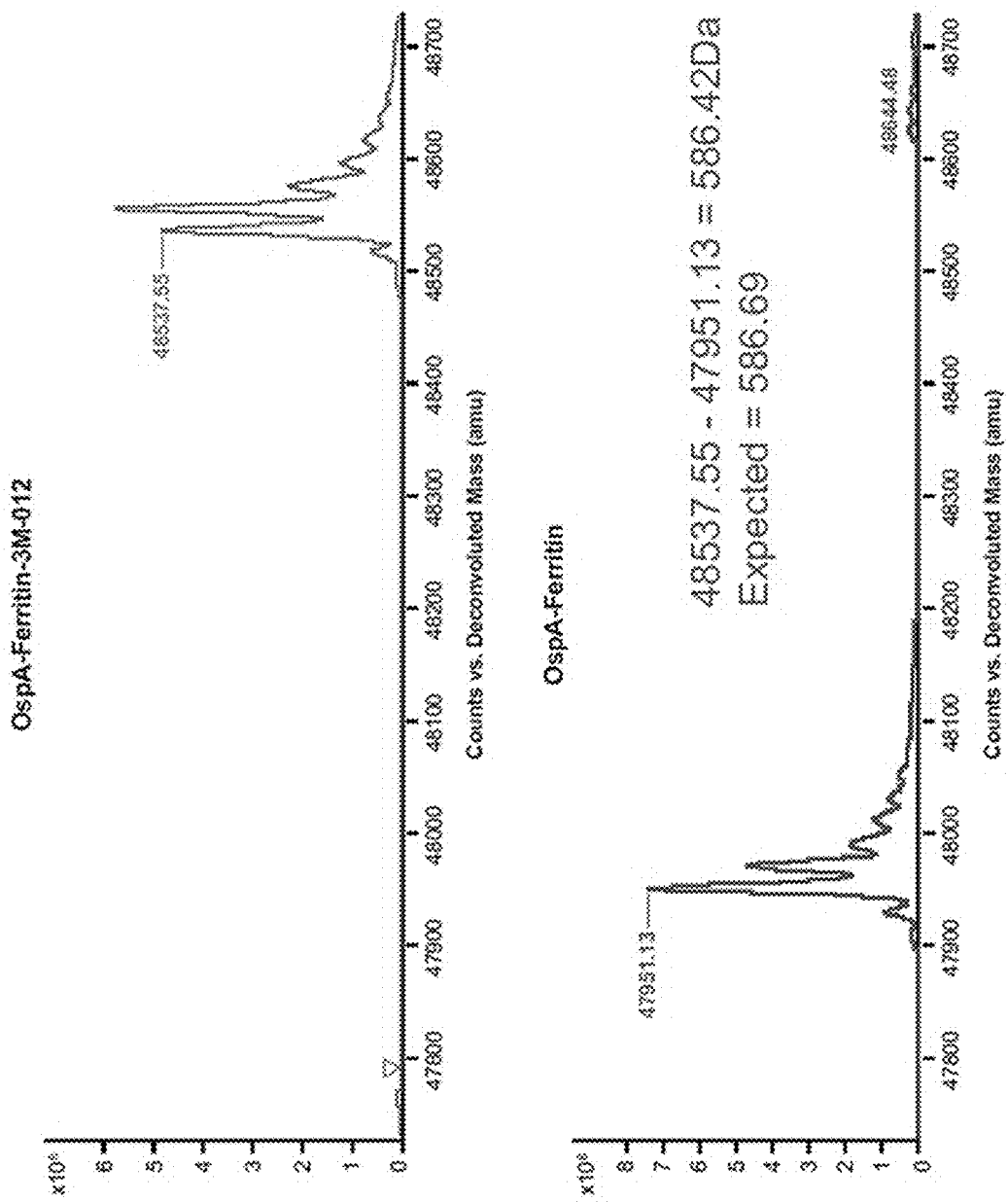

The TLR 7/8 agonist 3M-012, which has previously been shown to increase antibody responses when directly conjugated to the HIV Gag protein (see Wille-Reece, U., et al., Proc Natl Acad Sci USA 102(42): p. 15190-4 (2005)), was used. A two-step, click chemistry approach was used to attach 3M-012 to the nanoparticle of SEQ ID NO: 53. First, the DBCO-PEG4-maleimide linker was connected to the cysteine and then a modified 3M-012 with a PEG4-Azide linker was then added through copper-free azide-alkyne cycloadditions (FIG. 6A). >99% conjugation efficiency was confirmed by mass spectrometry with a mass shift of 587 Daltons (FIG. 12). In addition to azide-3M-012, azide-CPG was also successfully added (FIG. 7A), for which conjugation could be confirmed by gel shift (FIG. 7B).

Nearly complete conjugation of ferritin was observed, suggesting that most nanoparticles carried 24 molecules of agonists. The immunogenicity of the conjugated OspA ferritin nanoparticles was then assessed in mice. C3H/HeN mice were vaccinated intramuscularly at week zero and week 4. ELISAs were run on serum from 2 weeks post $2^{nd}$ dose. Alum (Alyhydrogel '85 2%; Brenntag—Cat #21645-51-2) was added in equal volume to antigen prior to immunization. Ribi (Sigma adjuvant system Cat #S6322-1vl) was resuspended in 1 ml of PBS and vortexed for 1 minute and then added in equal volume to antigen prior to immunization.

Figure 6B:
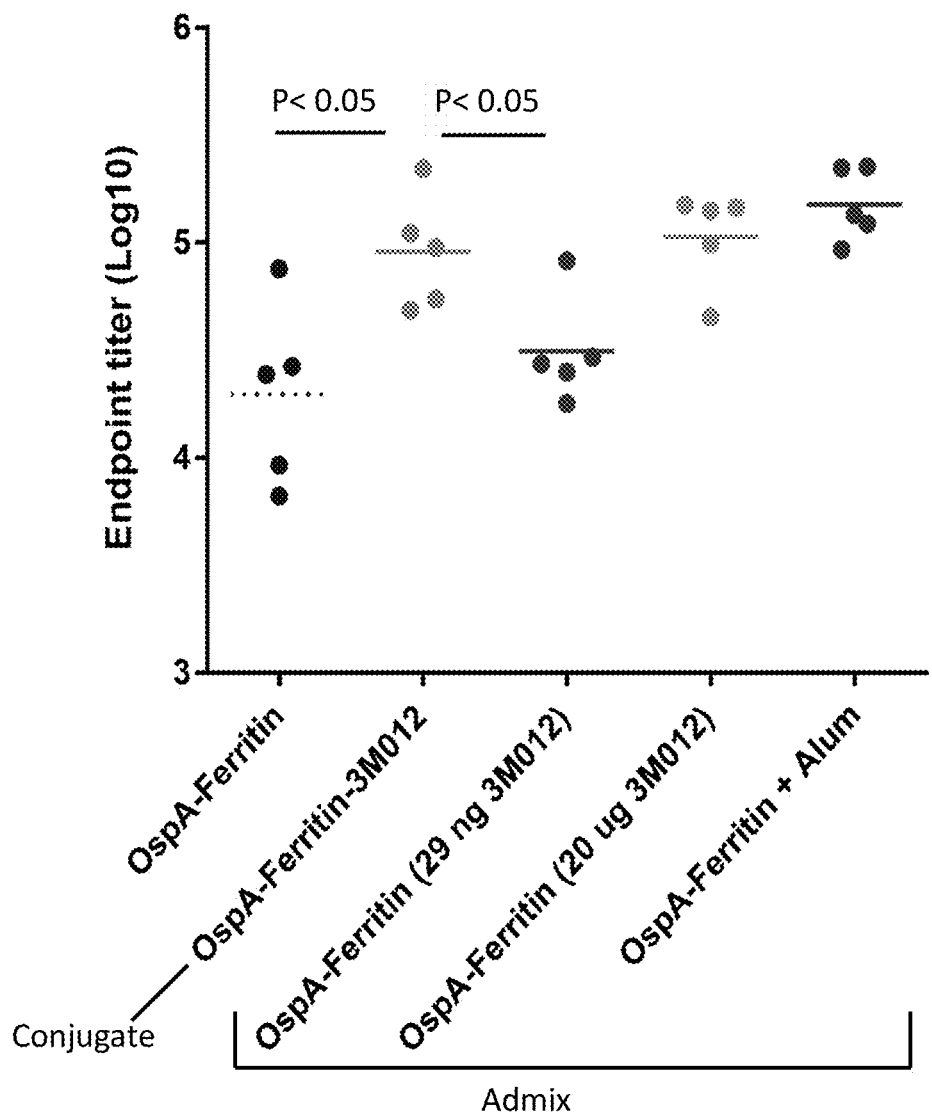

Mice immunized with 3M-012 conjugated particles produced 4.5-fold higher OspA antibody responses than the unconjugated material (FIG. 6B, p<0.05). The antibody responses elicited by 3M-012 conjugated particles were higher than the particles mixed with molar equivalent amount of 3M-012 (29 ng) and comparable to particles mixed with 1,000-fold higher dose (20 µg) of 3M-012 or a standard Alum (Alyhydrogel '85 2%; Brenntag—Cat #21645-51-2) adjuvant.

Figure 7C:
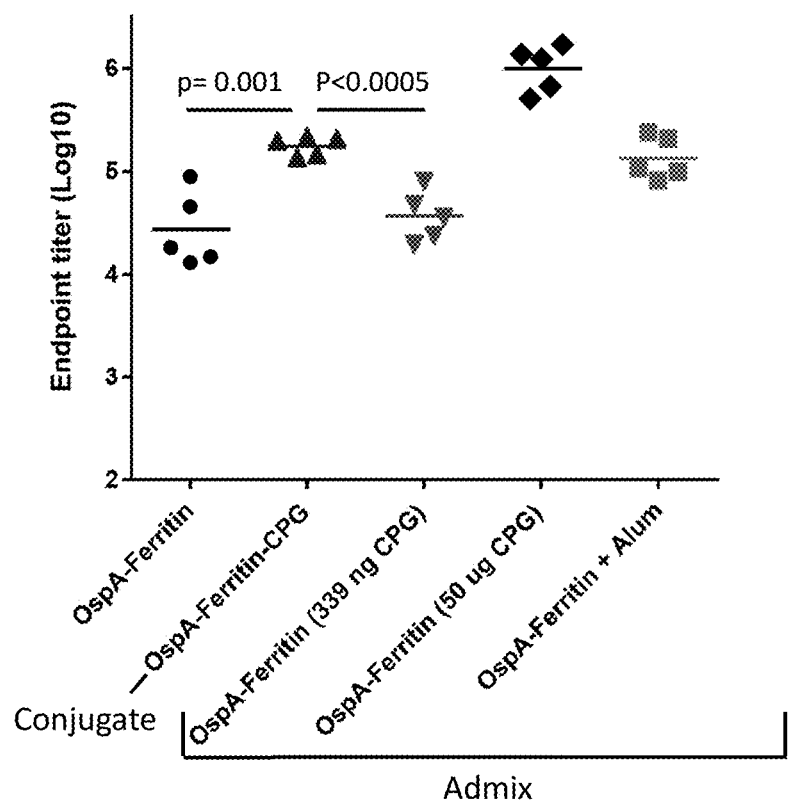
Figure 8A:
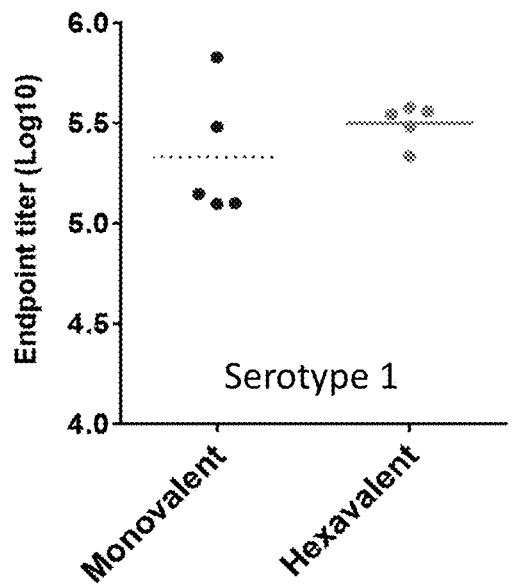
Figure 8B:
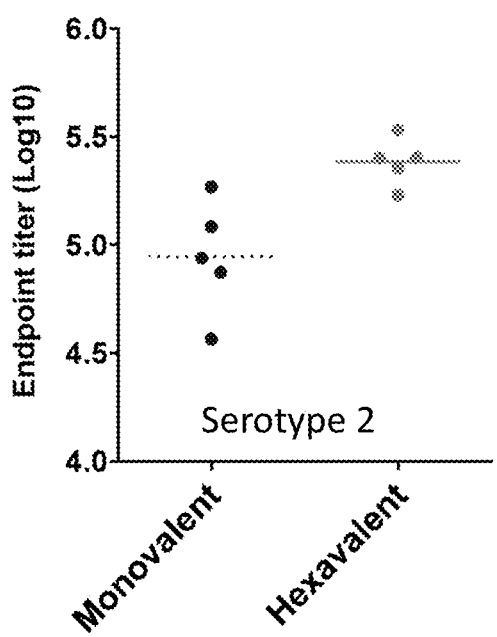
Figure 8C:
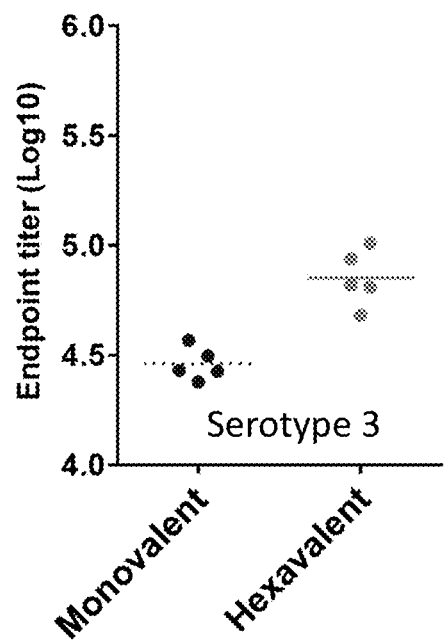
Figure 8D:
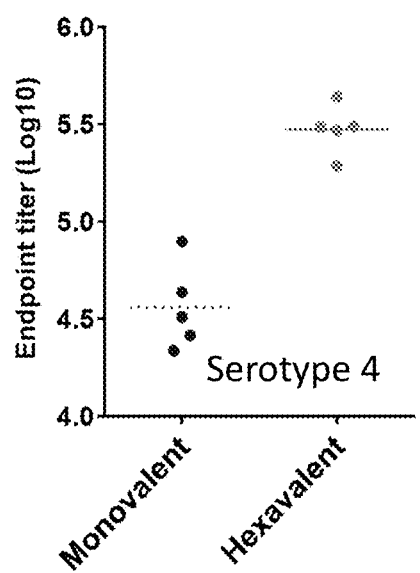
Figure 8E:
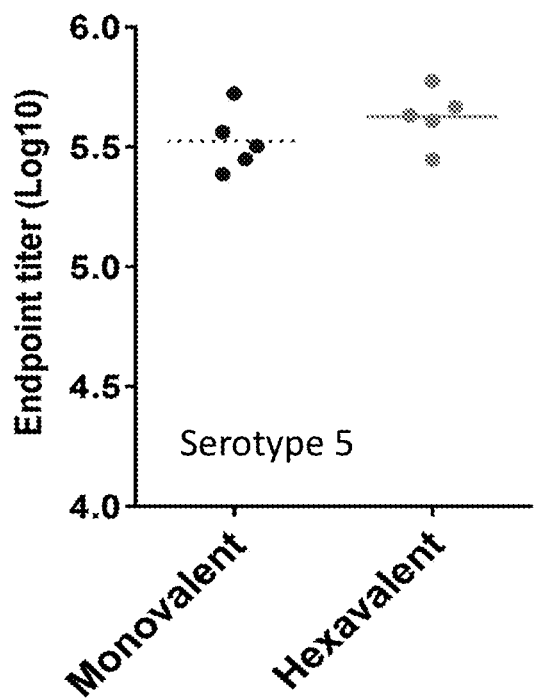
Figure 8F:
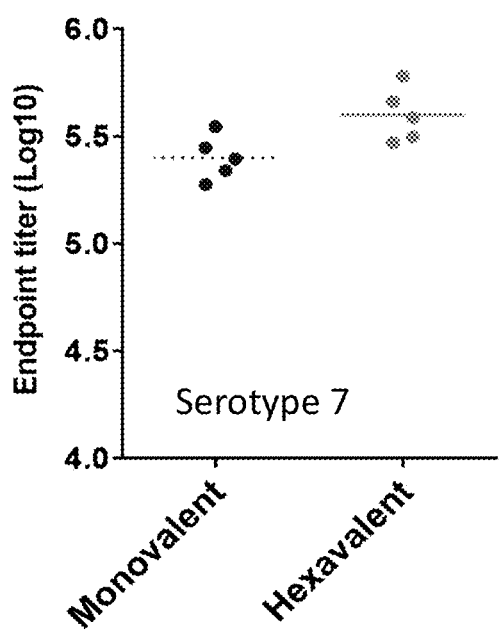
Figure 9A:
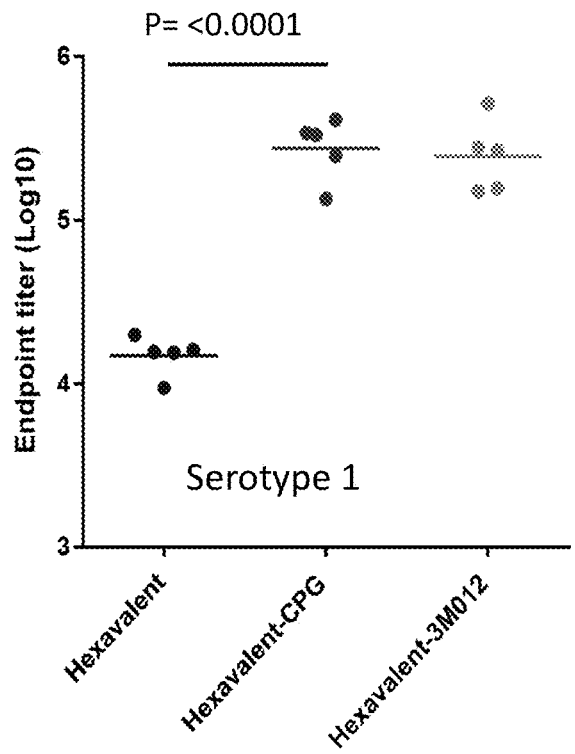
Figure 9B:
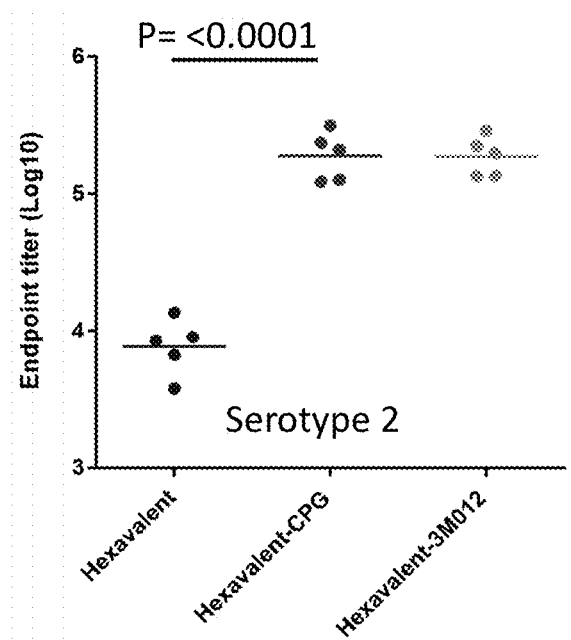
Figure 9C:
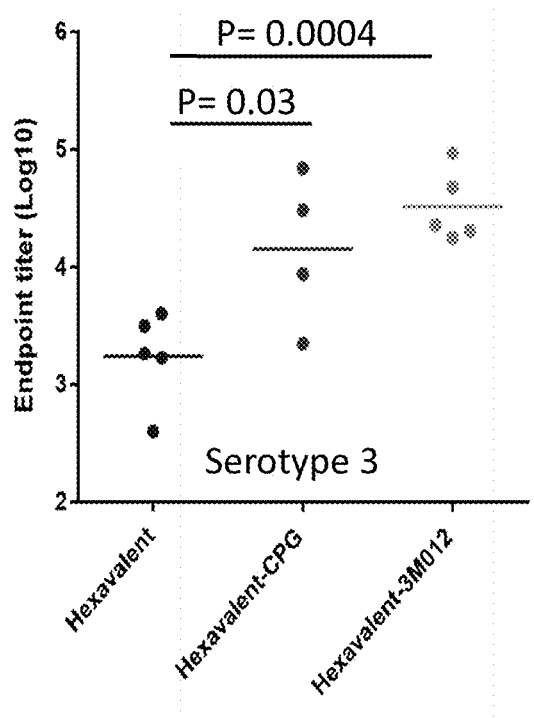
Figure 9D:
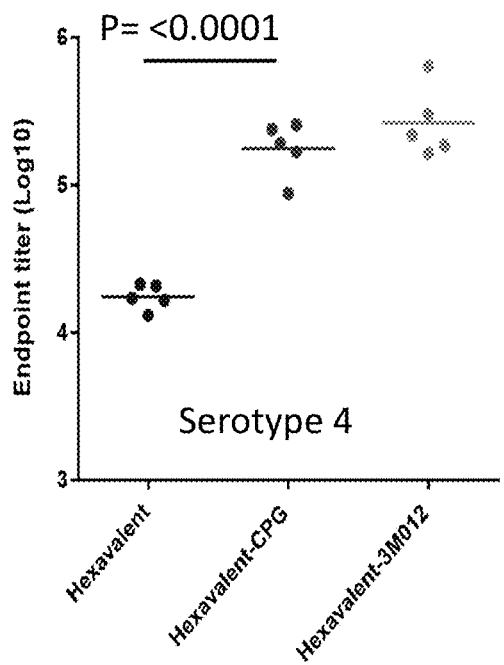
Figure 9E:
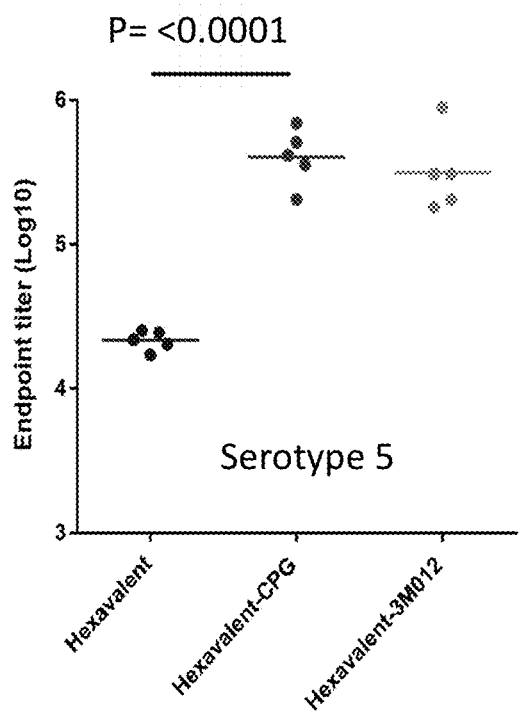
Figure 9F:
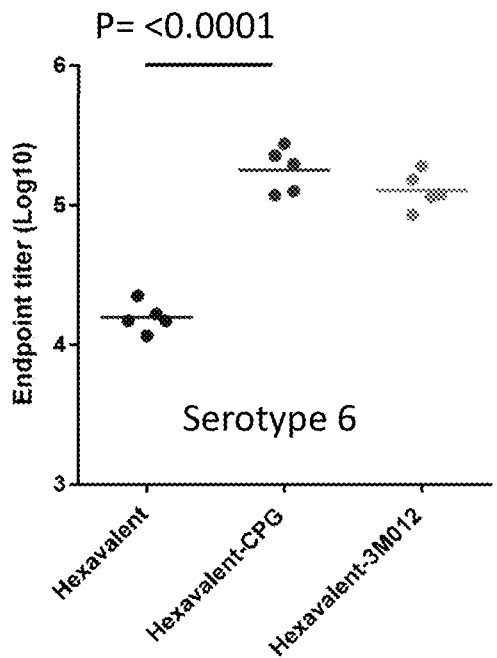
Figure 9G:
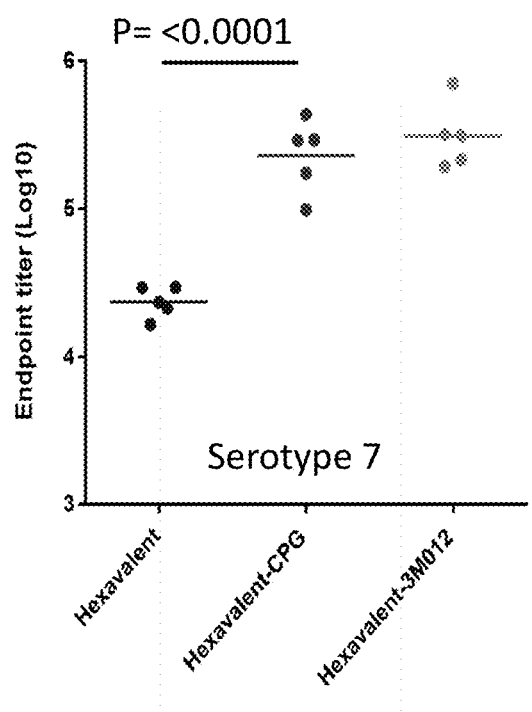
Figure 10D:
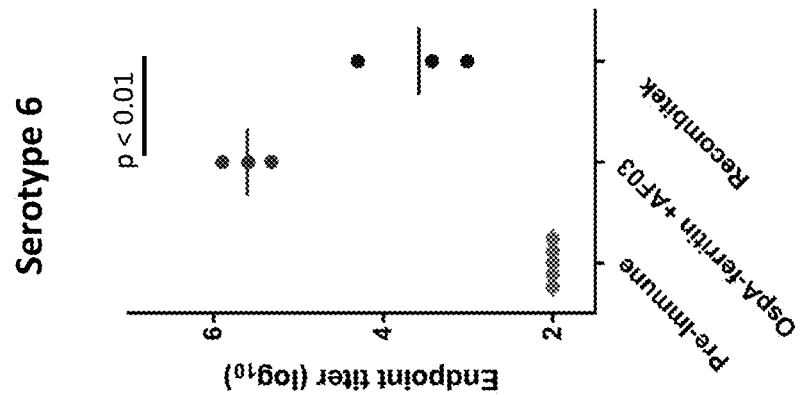
Figure 10E:
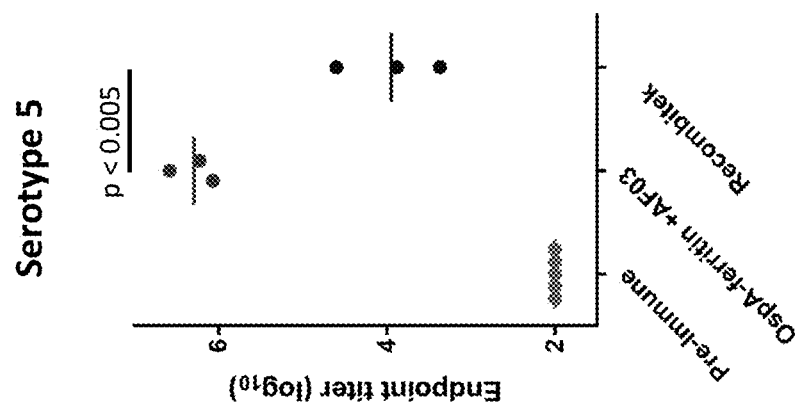
Figure 10F:
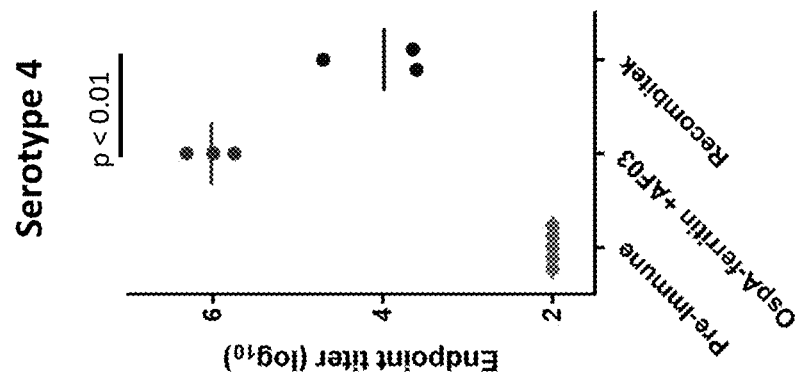
Figure 10I:
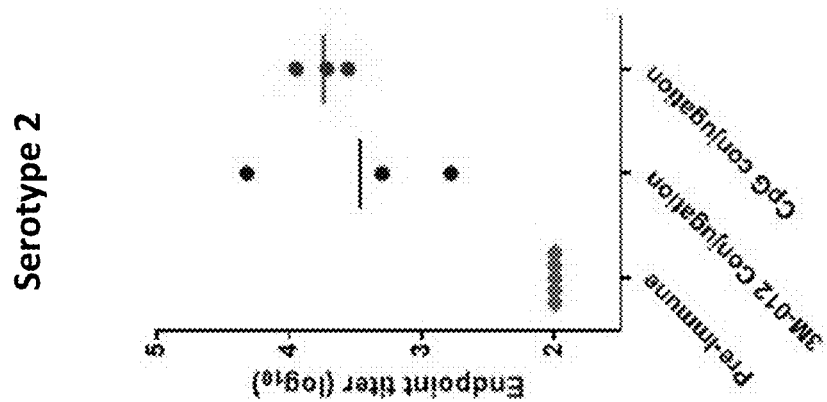
Figure 10H:
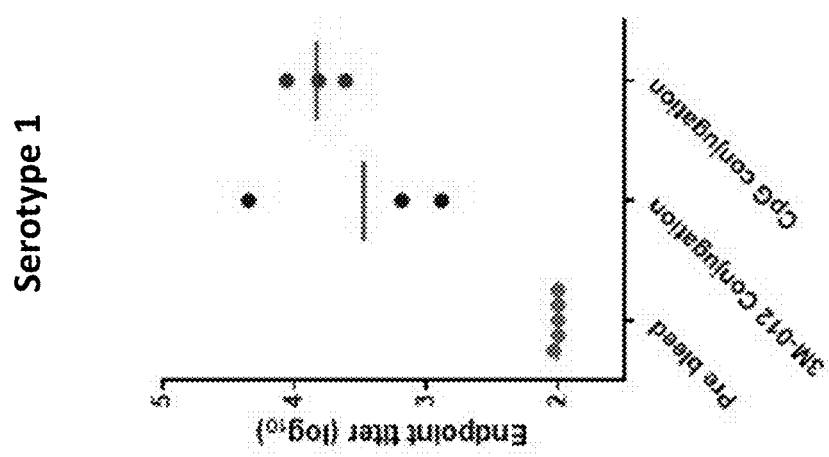
Figure 10G:
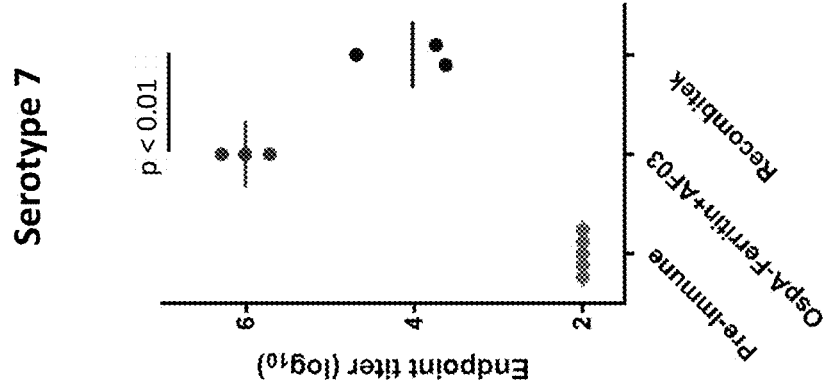
Figures 10J, 10K, 10L:
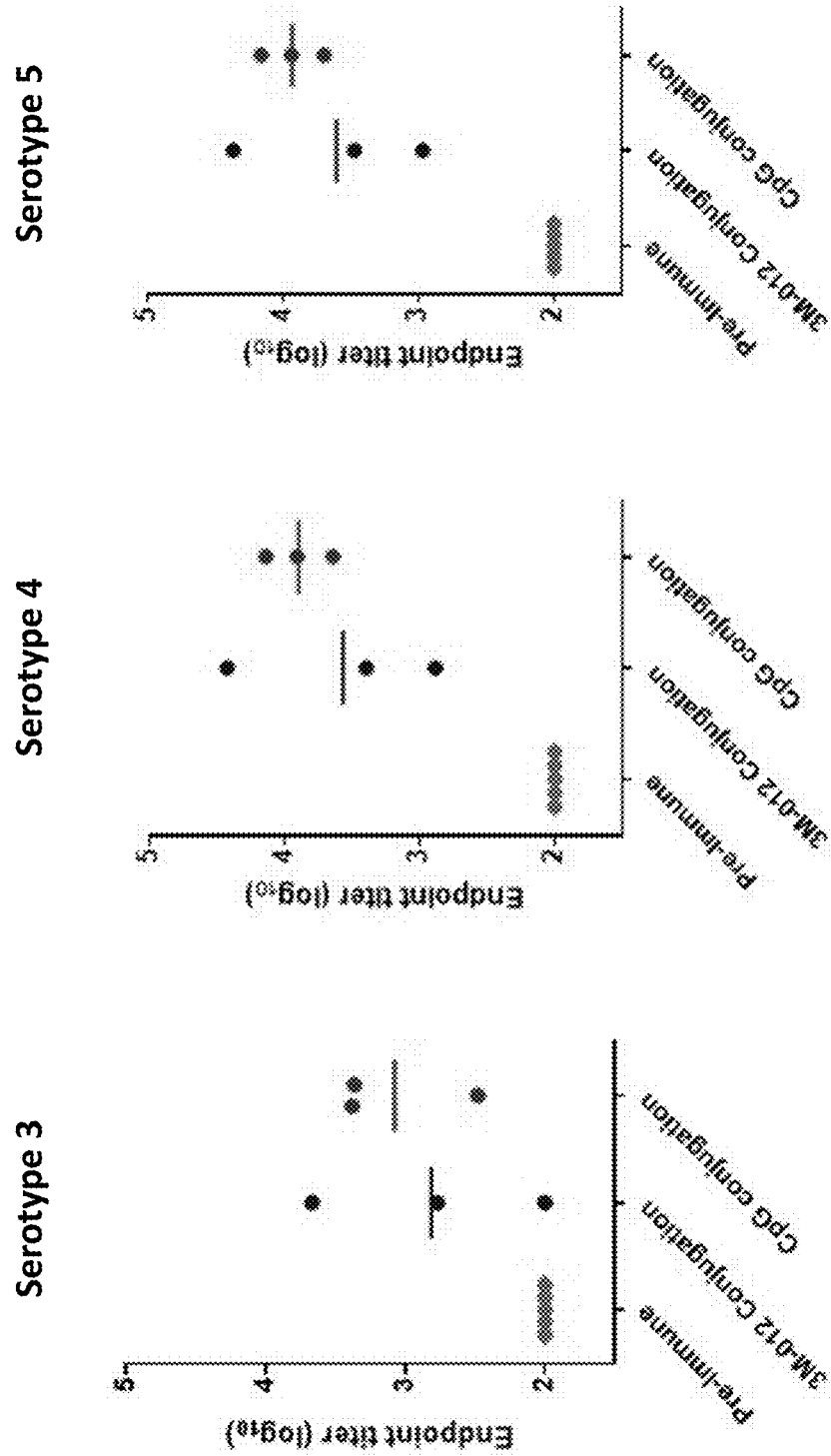
Figures 10M, 10N:
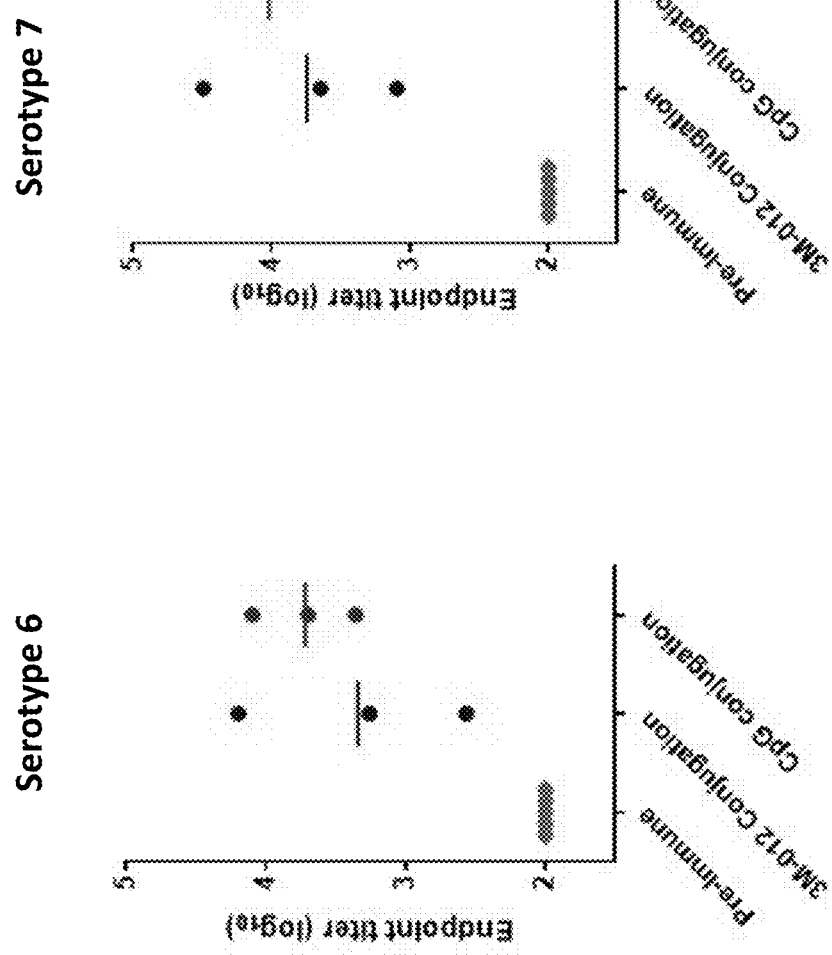

A similar enhancement of antibody production was observed with CPG-conjugated OspA-ferritin nanoparticle (SEQ ID NO: 53) with a 6.3-fold increase in the immune response compared to unconjugated particles, and a 4.7-fold increase relative to an equivalent amount of unconjugated CPG mixed with nanoparticle (FIG. 7C).

Thus, targeted delivery of adjuvant conjugated to a OspA-ferritin nanoparticle allows substantial reduction in the amount of adjuvant while stimulating an effective and specific antibody response.

Figure 3A:
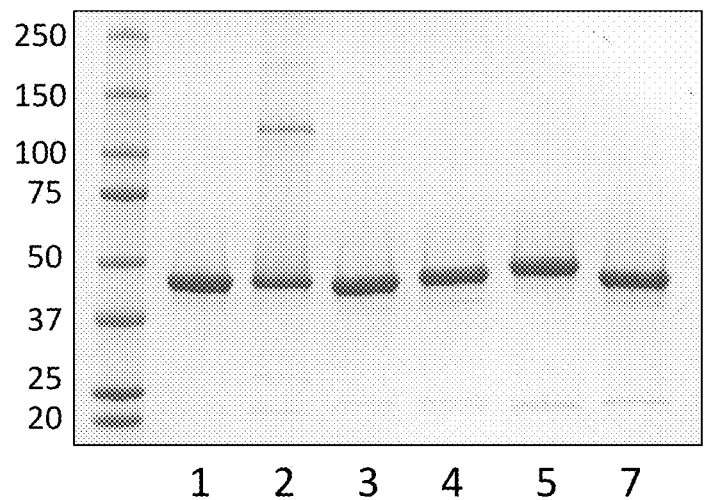
FIGS. 3A-3B show generation of alternative serotype OspA nanoparticles in *E. coli*.
Figure 3B:
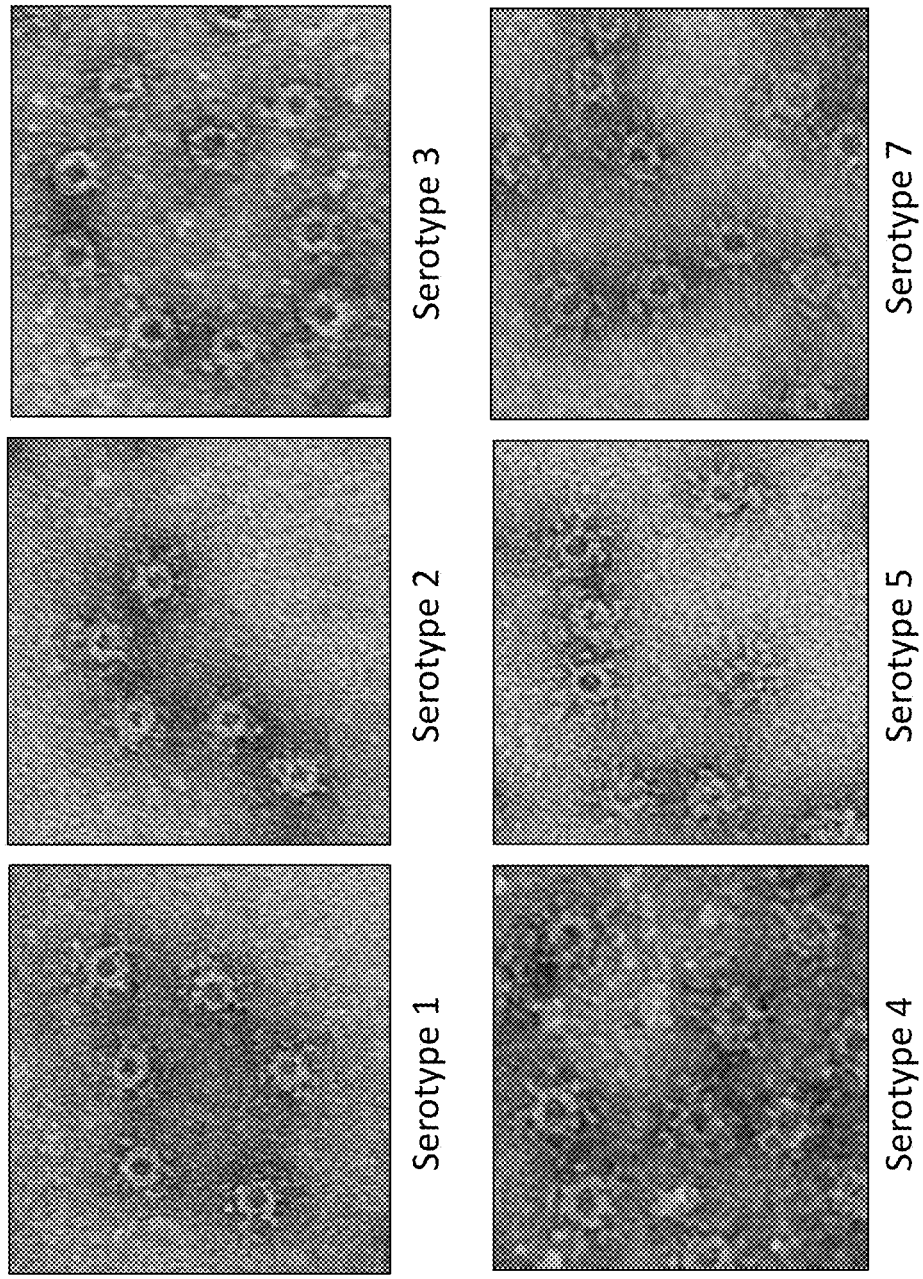

Example 5. Evaluation of Immunogenicity of OspA-Ferritin Nanoparticles Comprising Different Serotypes While the serotype 1 OspA strain *B. burgdorferi* causes disease in the United States, *B. afzelii* (serotype 2), *B. garinii* (serotype 3, 5, 6, 7), and *B. bavariensis* (serotype 4) cause disease in Europe, Asia, and elsewhere. To generate a broadly cross-protective composition, OspA-ferritin nanoparticles were designed for serotypes 1, 2, 3, 4, 5, and 7. (SEQ ID NOS: 1, 5, 6, 7, 8, and 10). These particles were expressed and purified from *E. coli* using anion exchange and size exclusion chromatography (FIG. 3A). All OspA-ferritin antigenic polypeptides have the expected molecular weight of 47 kDa and DLS analysis and transmission electron microscopy also confirmed the formation of all six OspA nanoparticles (FIG. 3B).

A six-component composition was generated by combining each of serotypes 1-5 and 7 of OspA-ferritin in equimolar proportions.

The immunogenicity of this six-component composition (i.e., hexavalent) with Alum was compared in mice to the single-serotype particles (i.e., monovalent) with the same adjuvant (FIGS. 8A-8F). The monovalent composition was given at 1 µg dose, and the hexavalent composition was given at 1 µg for each serotype (total of 6 µg dose). Alum (Alyhydrogel '85 2%; Brenntag—Cat #21645-51-2) was added in equal volume to antigen prior to immunization. The six-component composition induced a robust antibody response against all six of OspA serotypes 1-5 and 7. Moreover, the response to a single serotype control was similar to the mixture, indicating a lack of interference among the six-serotype combination. An improved immune response was seen against serotype 4 with the hexavalent composition relative to the single component composition (see FIG. 8D, serotype 4).

Having established that the hexavalent composition was immunogenic, and in some cases superior to the monovalent composition, 3M-012 and CpG conjugates of each of the six OspA-ferritin nanoparticles were prepared. Two six-component conjugated compositions were created by combining the six OspA-ferritin nanoparticles conjugated to 3M-012 and, separately, by combining the six OspA-ferritin nanoparticles conjugated to CpG. The CpG-conjugated and 3M-012-conjugated hexavalent compositions showed a significant increase in antibody response in mice over the unconjugated hexavalent composition for all seven serotypes of OspA found world-wide (FIG. 9A-9G), indicating that the hexavalent formulation also conferred protection against serotype 6 even though no OspA serotype 6 polypeptide was in the composition.

Figure 25:
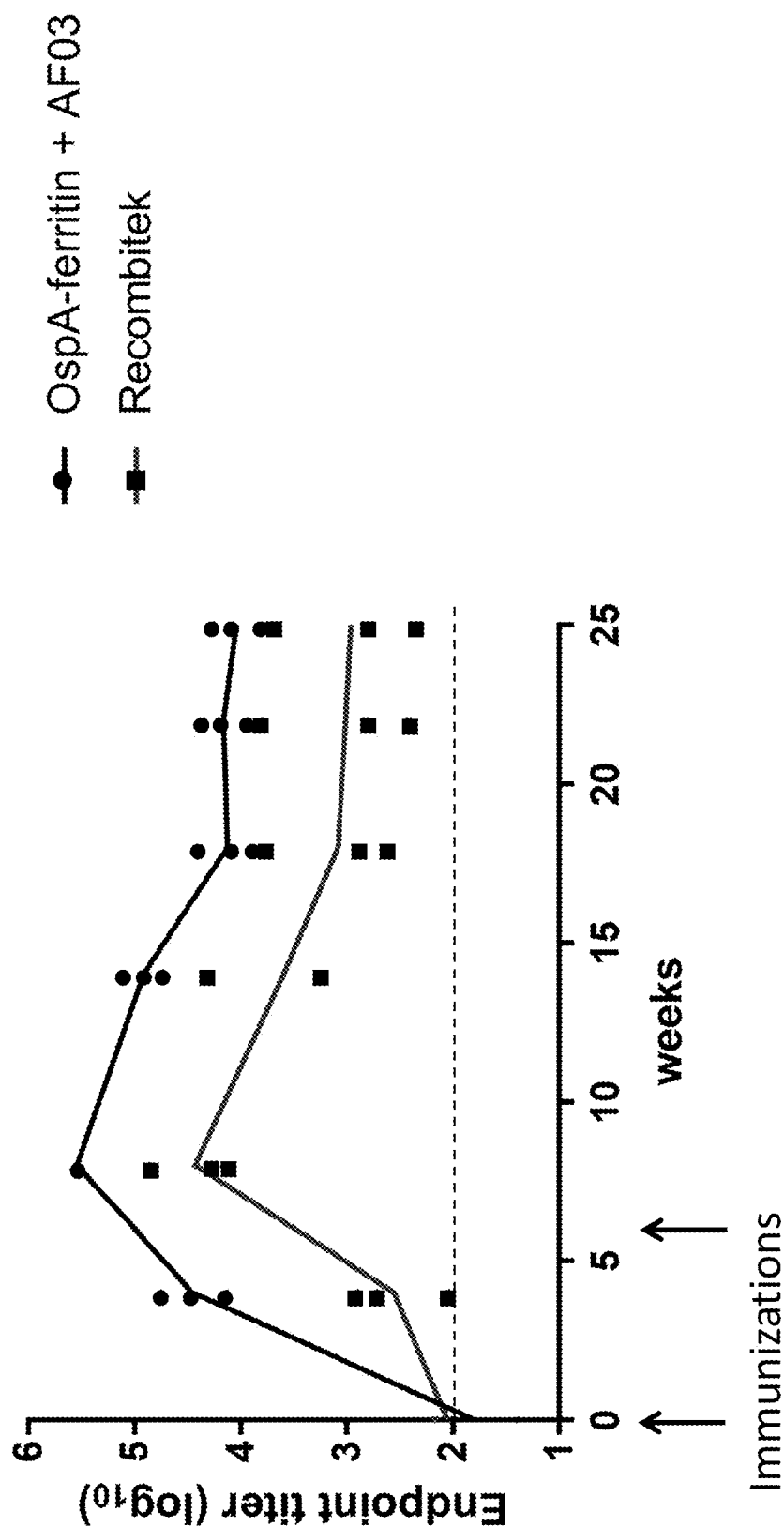
FIG. 25 shows a time course of endpoint antibody titer in Rhesus monkeys. Monkeys were immunized intramuscularly at week 0 and week 6 with either hexavalent OspA-ferritin vaccine (containing OspA of serotypes 1, 2, 3, 4, 5, and 7 in separate nanoparticles) with AF03 adjuvant or RECOMBITEK®. ELISA plate was coated with OspA serotype 1.

When tested in non-human primates (NHP [Rhesus monkeys]), the hexavalent nanoparticle composition (unconjugated) with AF03 adjuvant outperformed the RECOMBITEK® Lyme control 11 to 200-fold higher Ab titer against all seven circulating *Borrelia* serotypes (FIGS. 10A-10G). Similar to mice, hexavalent composition elicited high titer Ab response in the presence of adjuvant. The 3M-012 and CpG-conjugated compositions induced a similar response as RECOMBITEK® Lyme control in NHP (compare FIGS. 10A-G with 10H-N, respectively). Antibody titers for the hexavalent vaccine in NHP were robust out to 19 weeks after the boost dose and retained an advantage over the RECOMBITEK® Lyme control (FIG. 25).

Conjugated compositions were also tested in a tick challenge model. Mice were vaccinated with 1 µg dose of antigens at week 0 and week 4. The monovalent composition contained 1 µg of OspA-ferritin serotype 1 conjugated to 3M-012. The hexavalent composition included OspA from serotypes 1, 2, 3, 4, 5, and 7 at 1 µg each conjugated to 3M-012. Mice were challenged with 5-6 ticks infected with *Borrelia burgdorferi* N40 strain (serotype 1) for 5 days two weeks after the second immunization and sacrificed two weeks later. Tissue samples from the heart, ankle and ear were cultured in BSK media with antibiotics for *B. burgdorferi* for 6 weeks. Negative samples were tested by PCR for the presence of *B. burgdorferi*. Positive samples were positive for either culture or PCR. (FIG. 11).

We additionally tested a heptavalent vaccine containing all seven serotypes in mice. Mice were immunized intramuscularly at week 0 and week 4 with heptavalent OspA-ferritin nanoparticle compositions of 1 ug each of OspA-ferritin nanoparticles corresponding to OspA serotypes 1-7 (total 7 ug) adjuvanted with either alum or AF03, or with RECOMBITEK® Lyme (1 µg dose). Antibody response was analyzed 2 weeks after immunization via endpoint titer measured by ELISA. A robust immune response was demonstrated as compared to RECOMBITEK® (FIG. 24A-G).

Thus, OspA-ferritin nanoparticles elicited high titer antibody responses to the seven major serotypes. Further, a seven-component Lyme vaccine candidate offers the potential to control the global spread of Lyme disease.

Example 6: Characterization of OspA-Ferritin Constructs with Different Flexible Linkers Several different linkers were tested to provide flexibility between OspA and ferritin. The constructs ranged from one to five -GGGS- (SEQ ID NO: 443) sequences. The various linker constructs were purified and formed nanoparticles of uniform size.

Figure 15A:
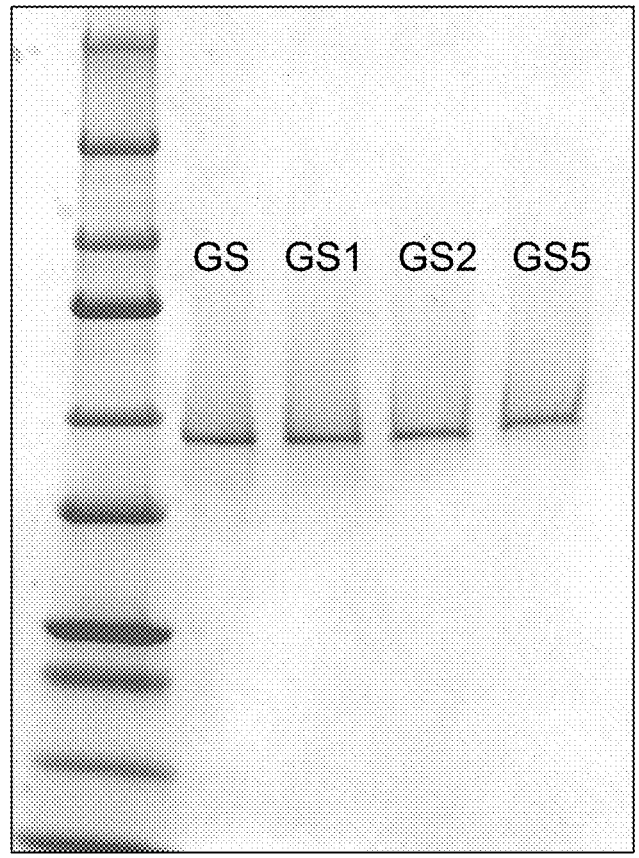
FIGS. 15A-15E show purification and characterization of OspA constructs comprising different linkers (GS, Gly-Ser linker; GS1, Gly-Gly-Gly-Ser linker (SEQ ID NO: 443); GS2, SEQ ID NO: 91 linker; GS5, SEQ ID NO: 92 linker; construct sequences were SEQ ID NOs: 53 and 60-62, respectively).
Figure 15B:
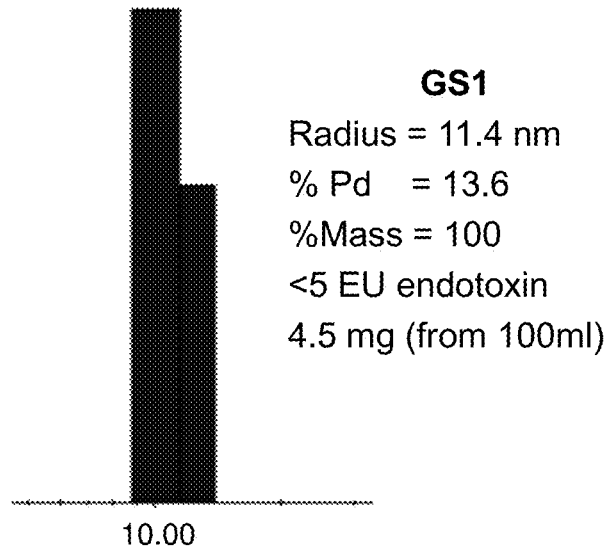
Figure 15C:
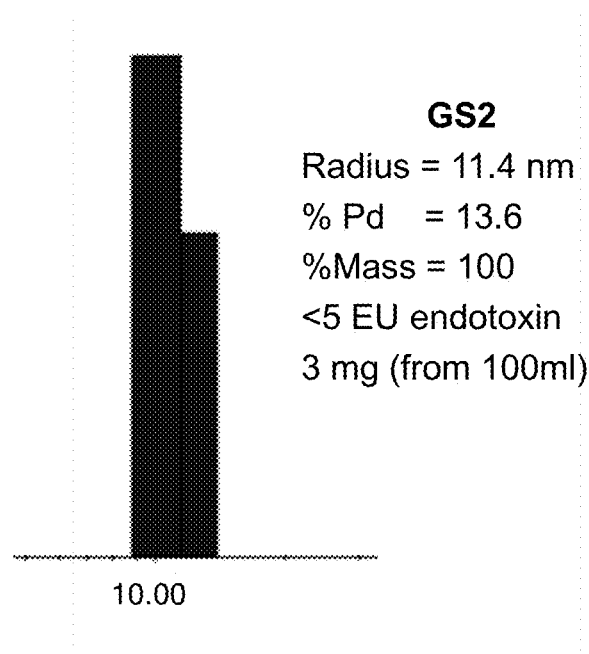
Figure 15D:
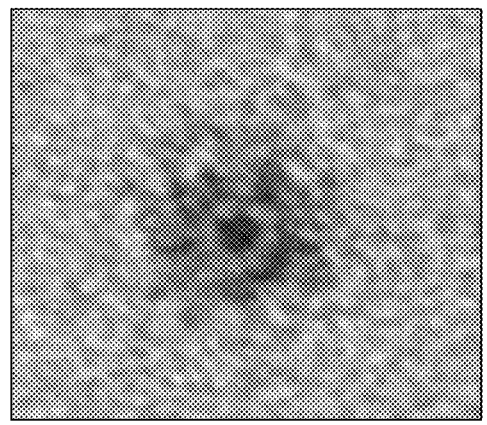
Figure 15E:
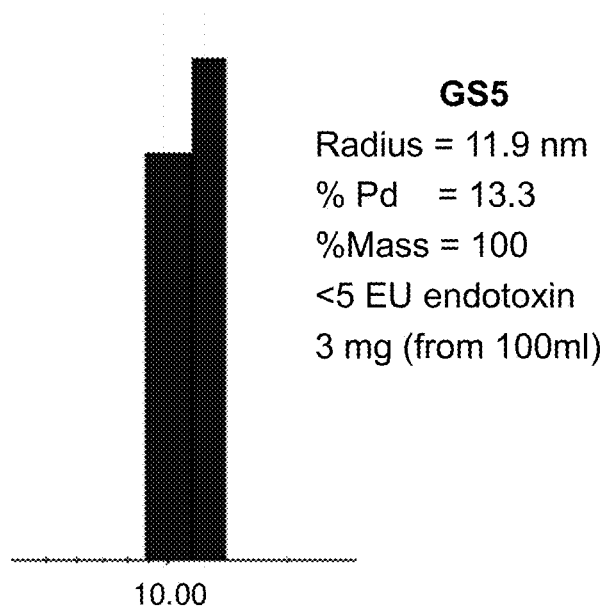

OspA-linker-ferritin constructs comprising GS1 (GGGS) (SEQ ID NO: 443), GS2 (SEQ ID NO: 91), or GS5 (SEQ ID NO: 92) linkers could all be expressed (FIG. 15A) and showed consistent DLS (FIGS. 15B, 15C, and 15E) and EM (FIG. 15D) profiles.

Figure 16:
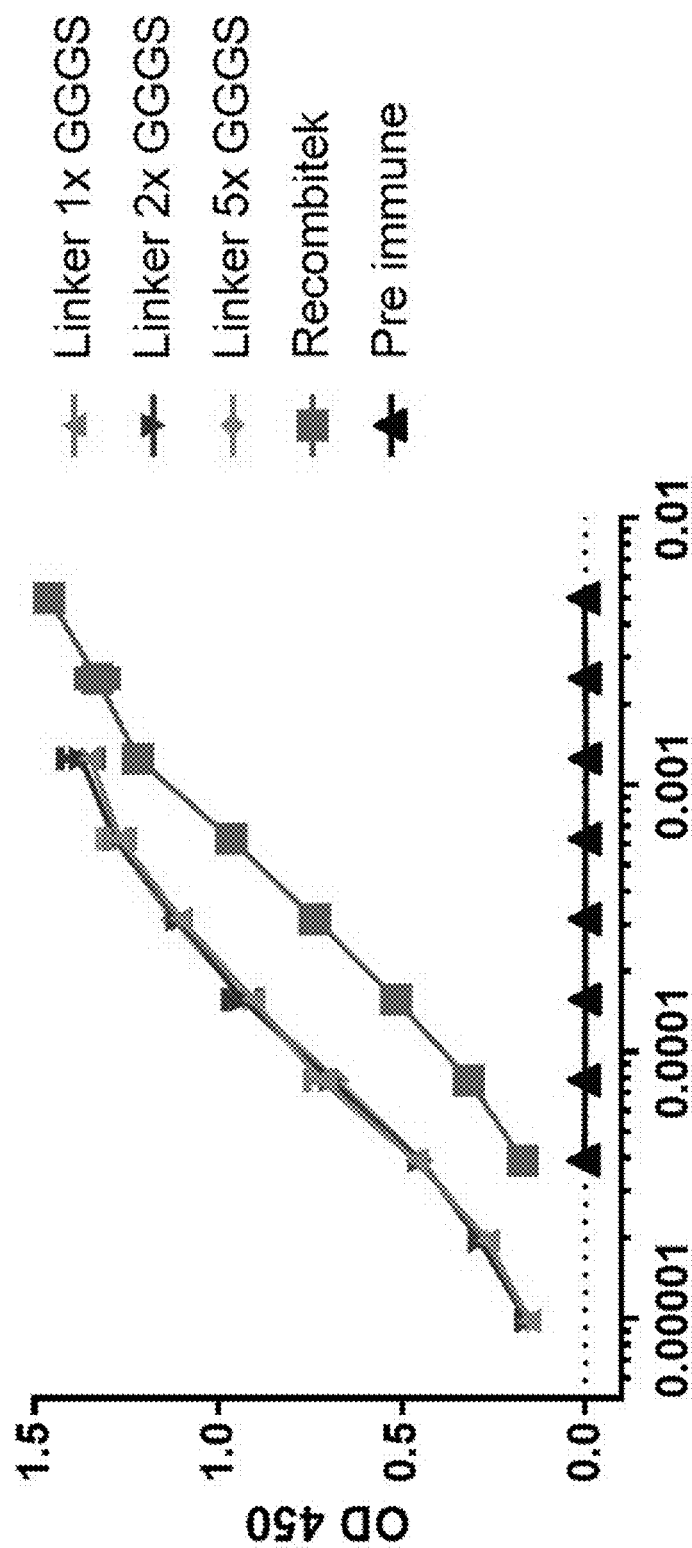
FIG. 16 shows antibody response in mice to OspA-ferritin constructs comprising different linkers (Linker 1×GGGS construct, SEQ ID NO: 60 ("1×GGGS" disclosed as SEQ ID NO: 443); Linker 2×GGGS construct, SEQ ID NO: 61 ("2×GGGS" disclosed as SEQ ID NO: 444); Linker 5×GGGS construct, SEQ ID NO: 62 ("5×GGGS" disclosed as SEQ ID NO: 445)) compared to RECOMBITEK® Lyme and negative (Pre-immune) controls, measured by ELISA across a dilution series as shown.

Further, the different -GGGS- linker constructs ("GGGS" disclosed as SEQ ID NO: 443) (Linker 1×GGGS ("1× GGGS" disclosed as SEQ ID NO: 443) [SEQ ID NO: 60], Linker 2×GGGS ("2×GGGS" disclosed as SEQ ID NO: 444) [SEQ ID NO: 61], and Linker 5×GGGS ("5×GGGS" disclosed as SEQ ID NO: 445) [SEQ ID NO: 62]) all showed strong immune responses in C3H mice (FIG. 16).

Example 7: Characterization of Lumazine Synthase OspA Nanoparticles

Figure 17B:
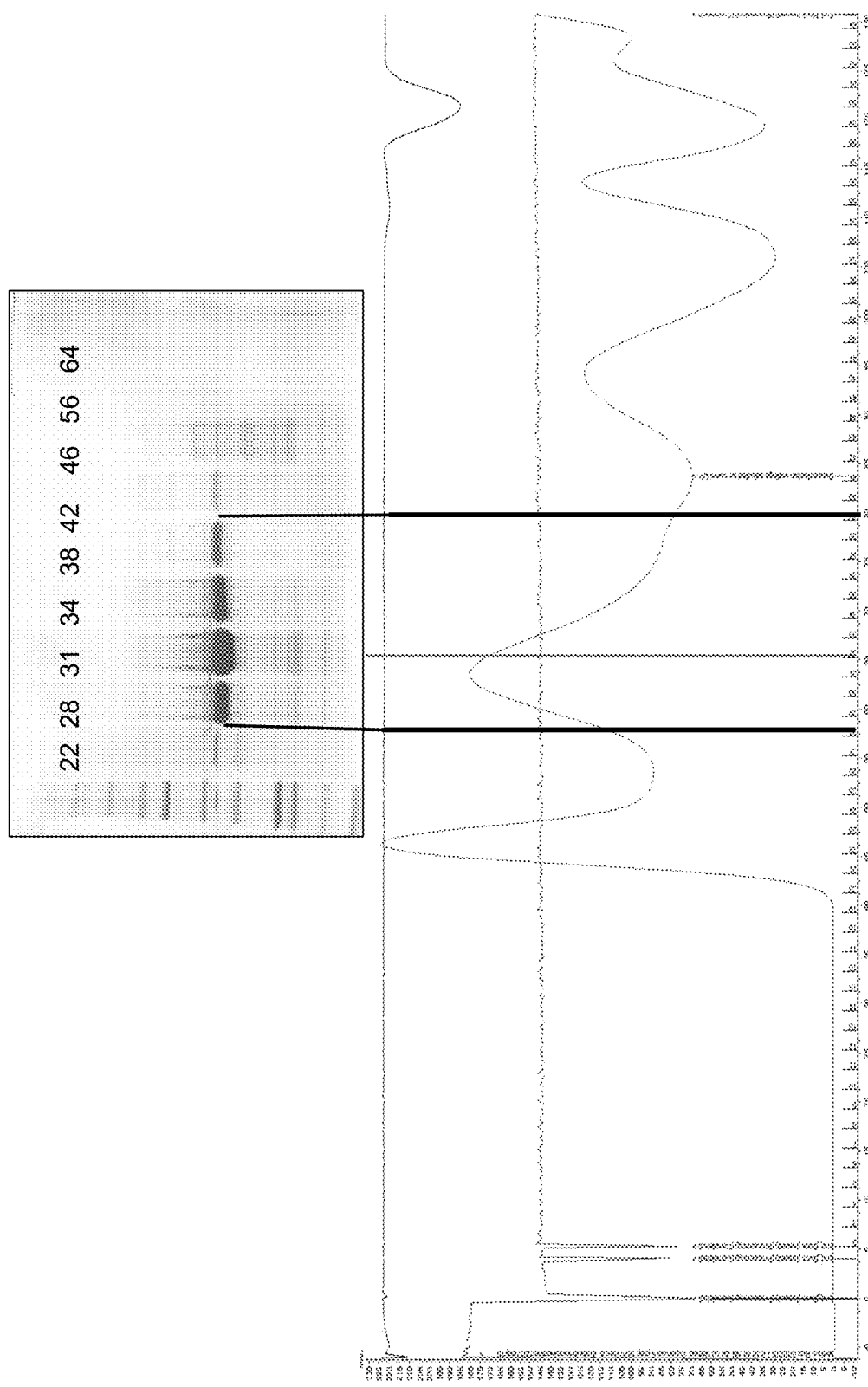
Figure 19C:
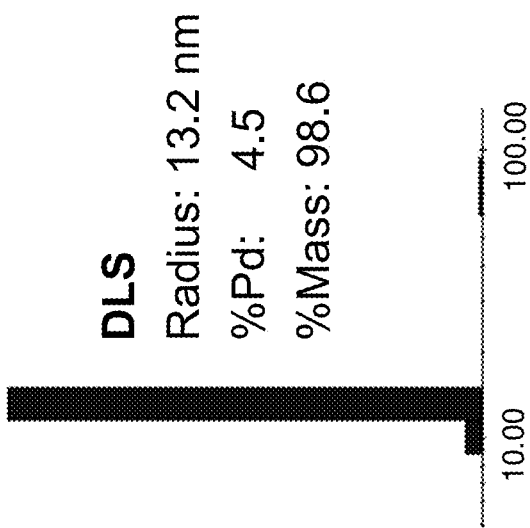
FIGS. 19A-19C show characterization of a OspA serotype 1-lumazine synthase construct (SEQ ID NO: 12).
Figure 19A:
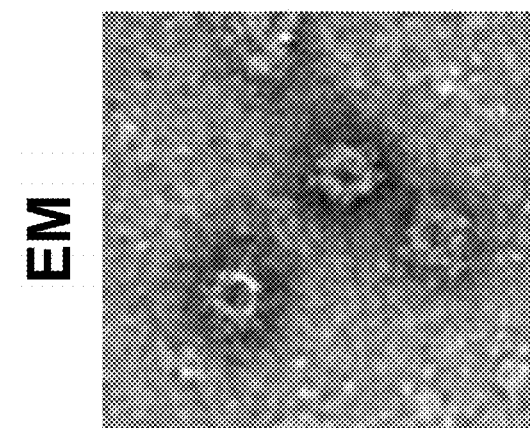
Figure 19B:
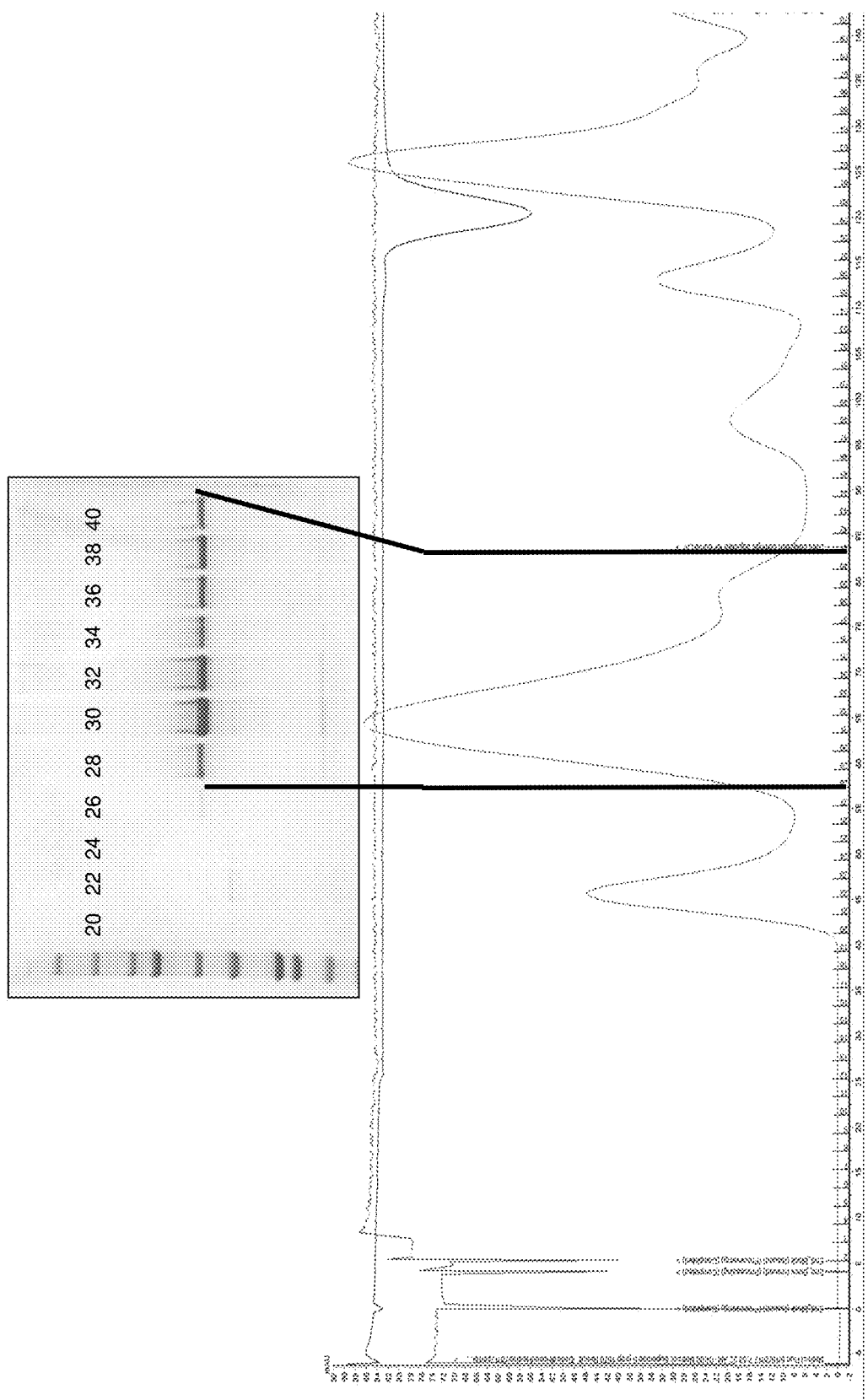
Figure 20B:
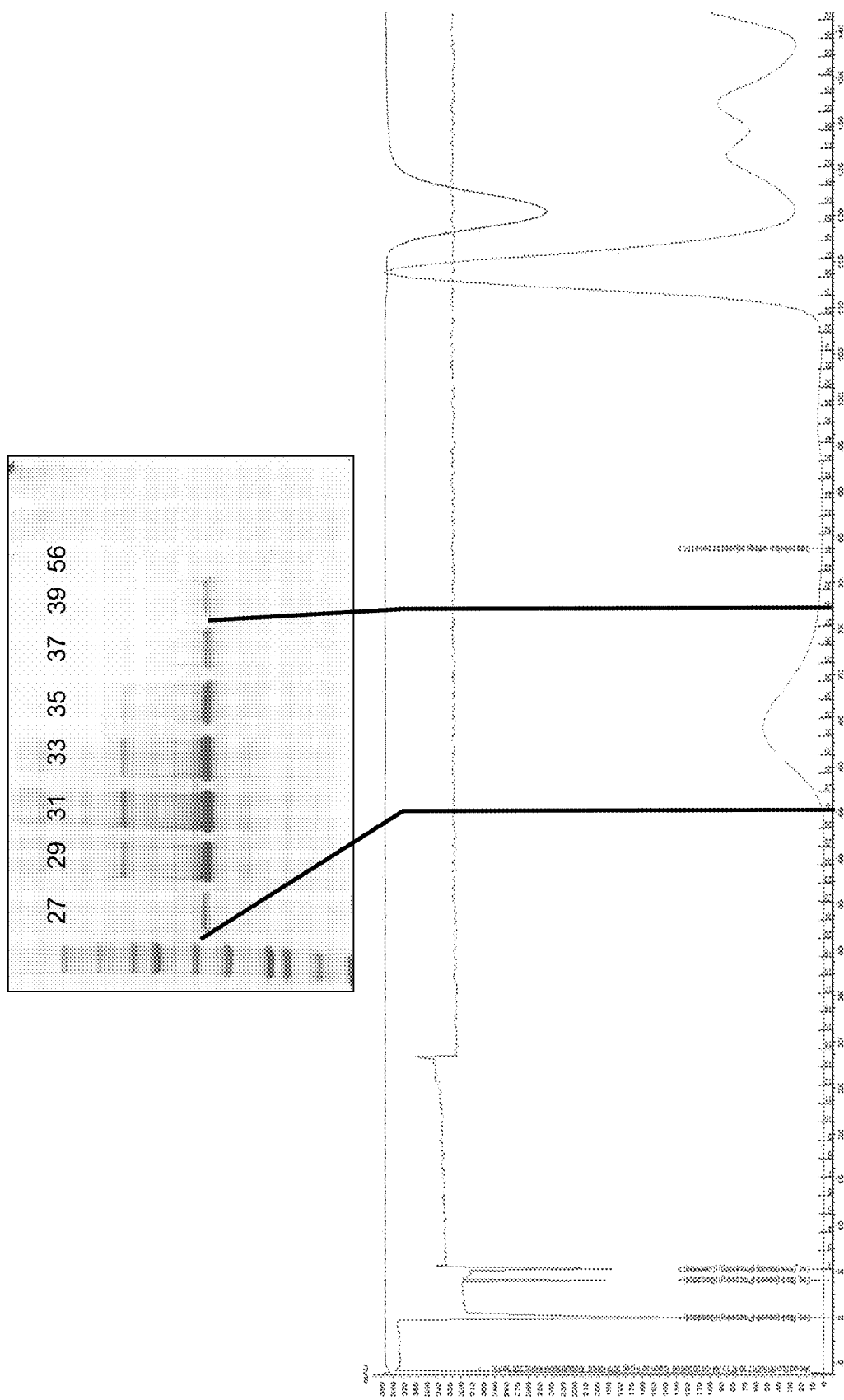
Figure 21A:
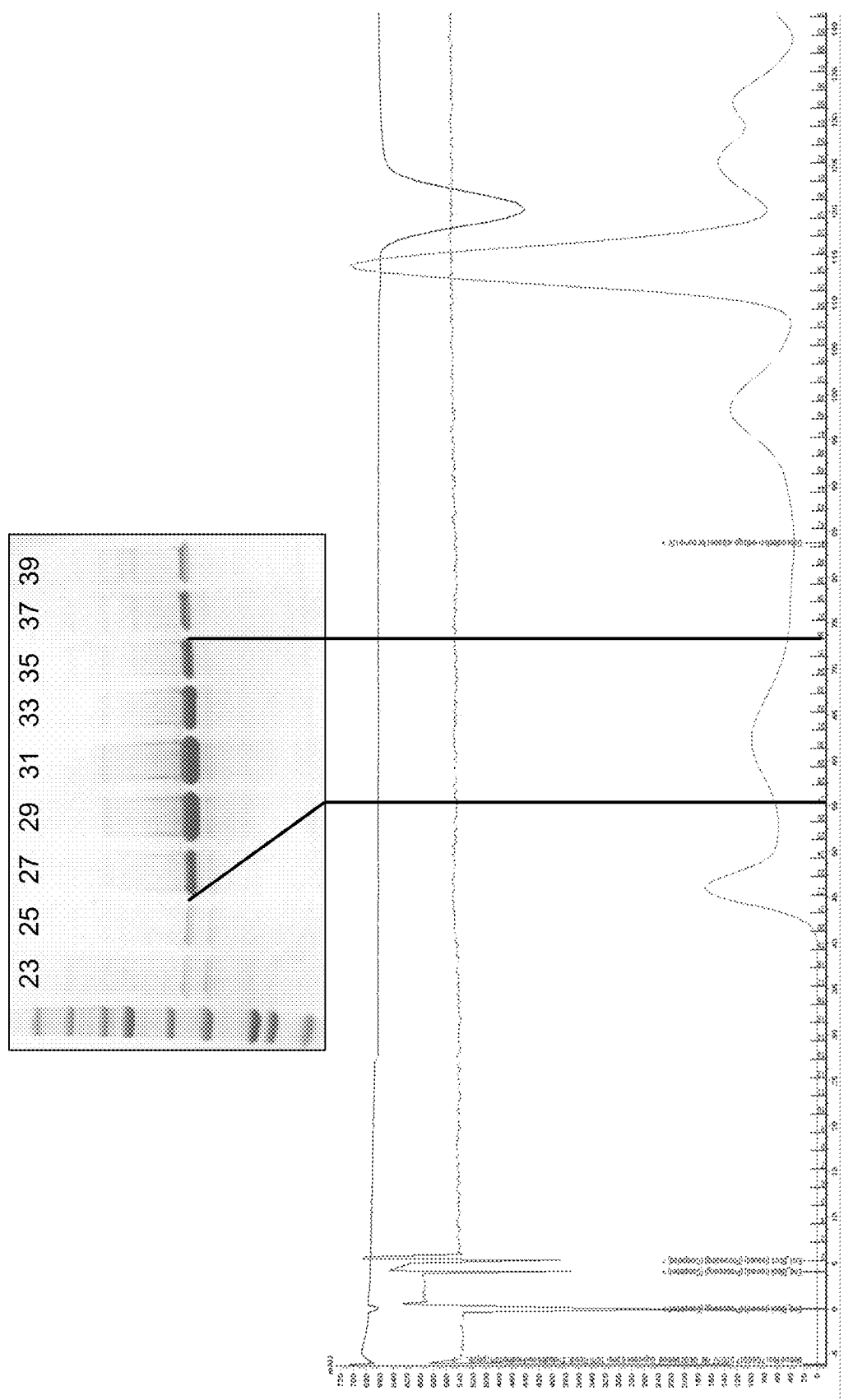
FIGS. 21A-21B show characterization of a OspA serotype 3-lumazine synthase construct (SEQ ID NO: 17).
Figure 22A:
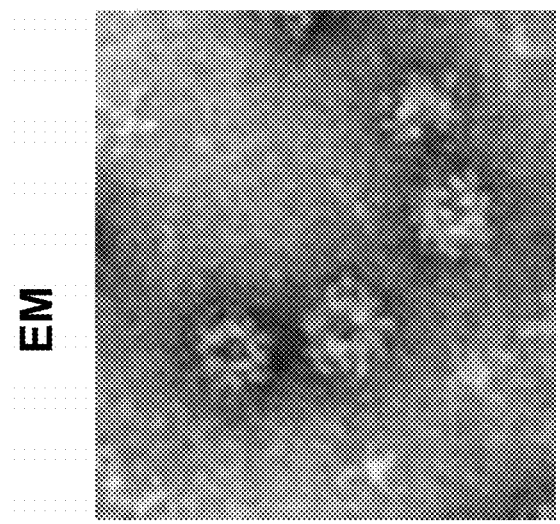
FIGS. 22A-22C show characterization of a OspA serotype 5-lumazine synthase construct (SEQ ID NO: 19).
Figure 21B:
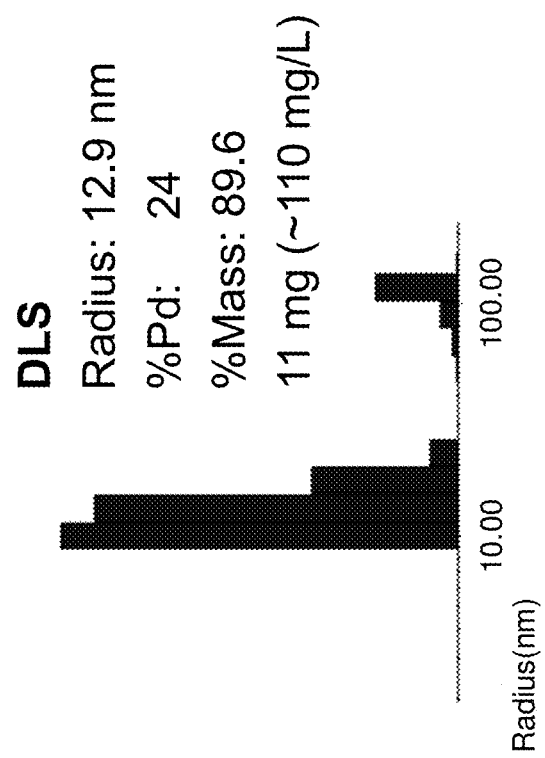
Figure 22B:
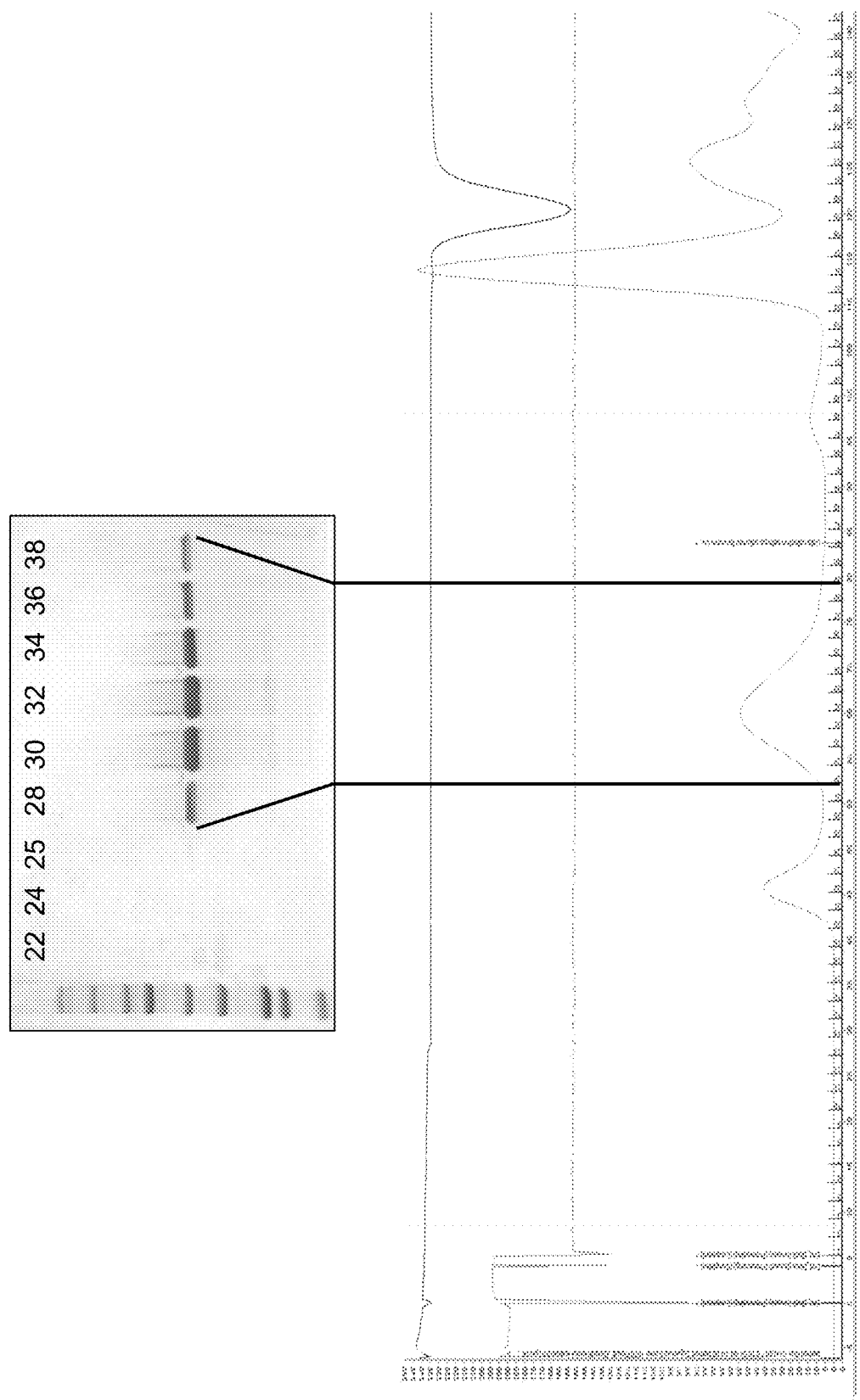
Figures 22C, 23A:
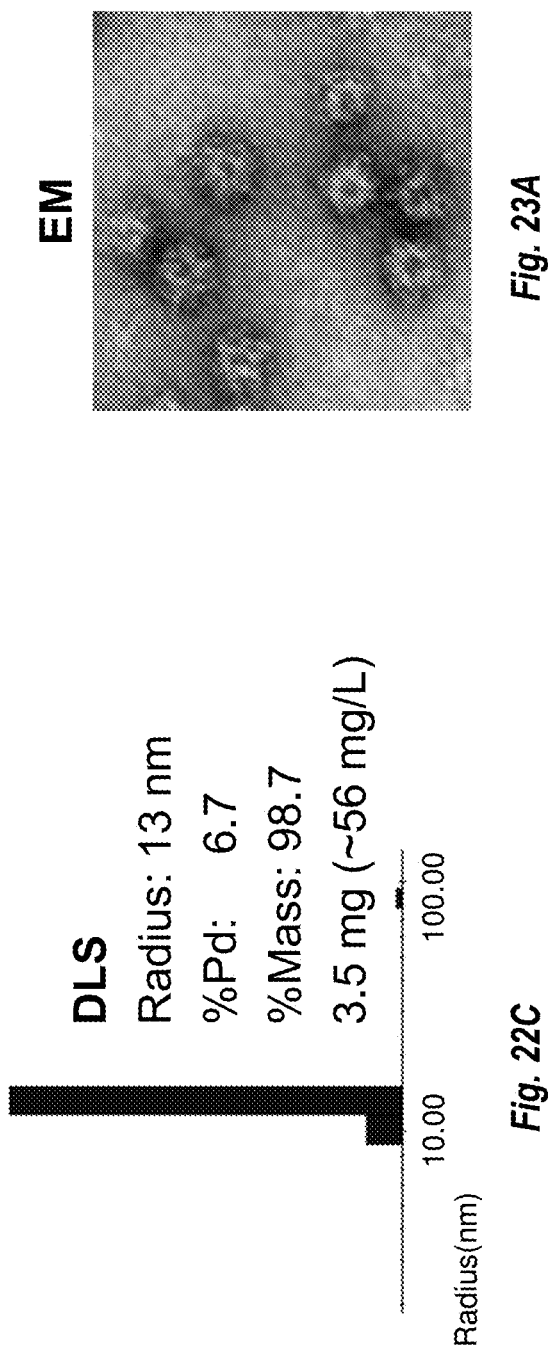
FIGS. 23A-23C show characterization of a OspA serotype 7-lumazine synthase construct (SEQ ID NO: 21).
Figure 23B:
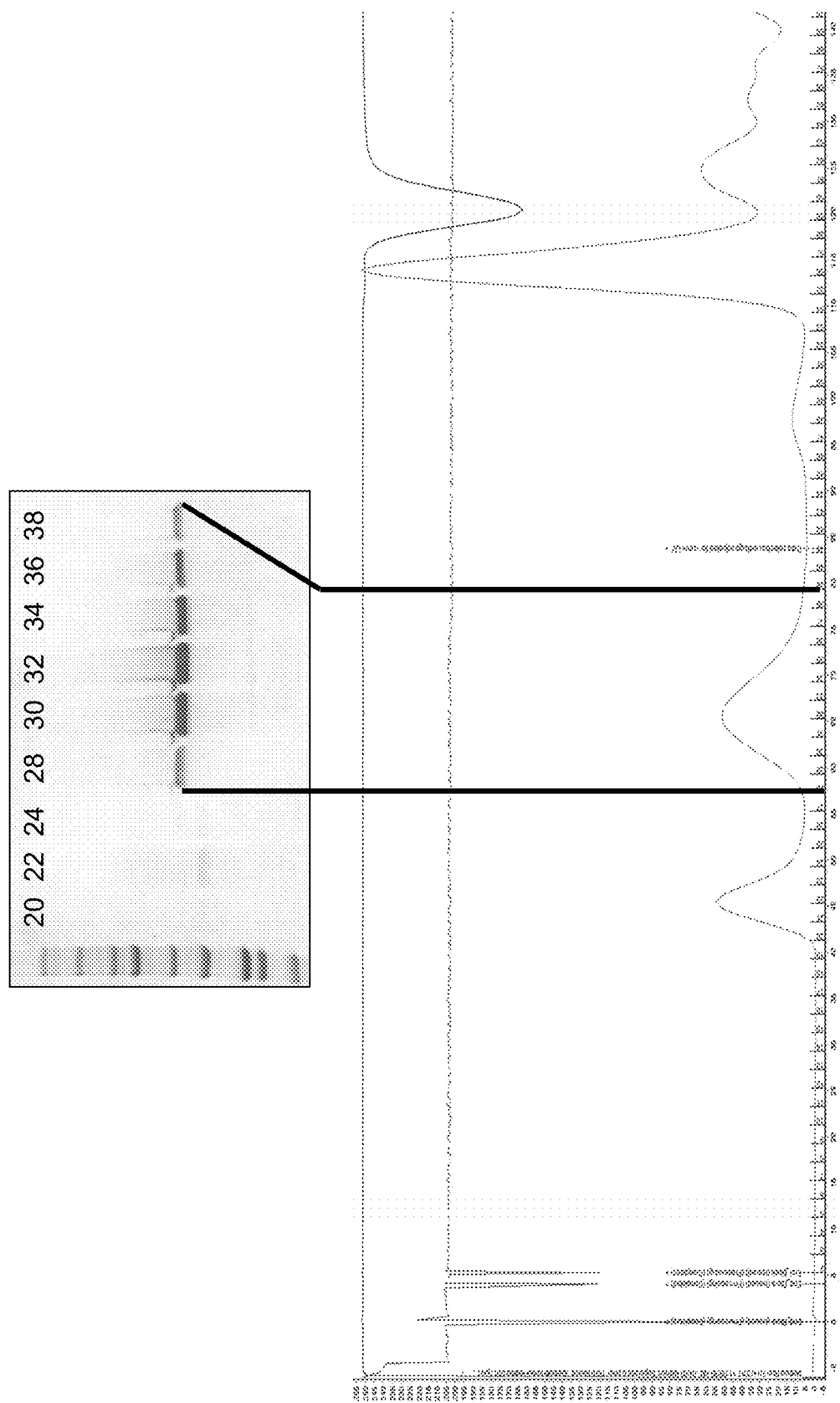
Figure 23C:
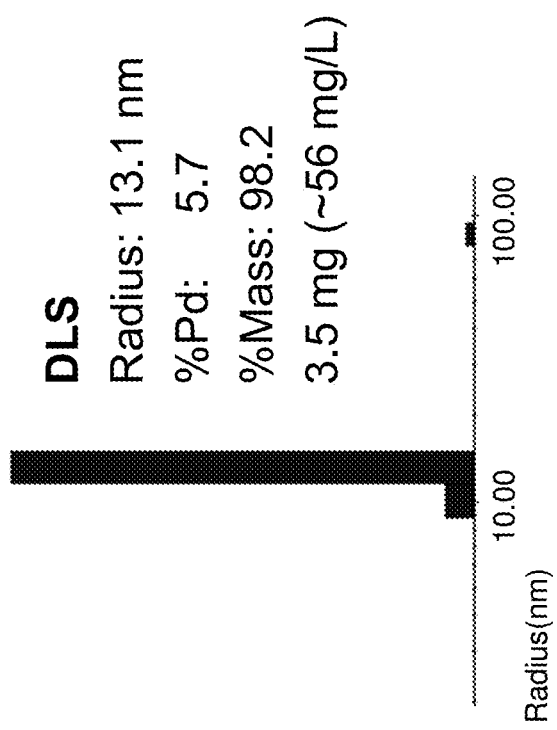
Figures 24A, 24B:
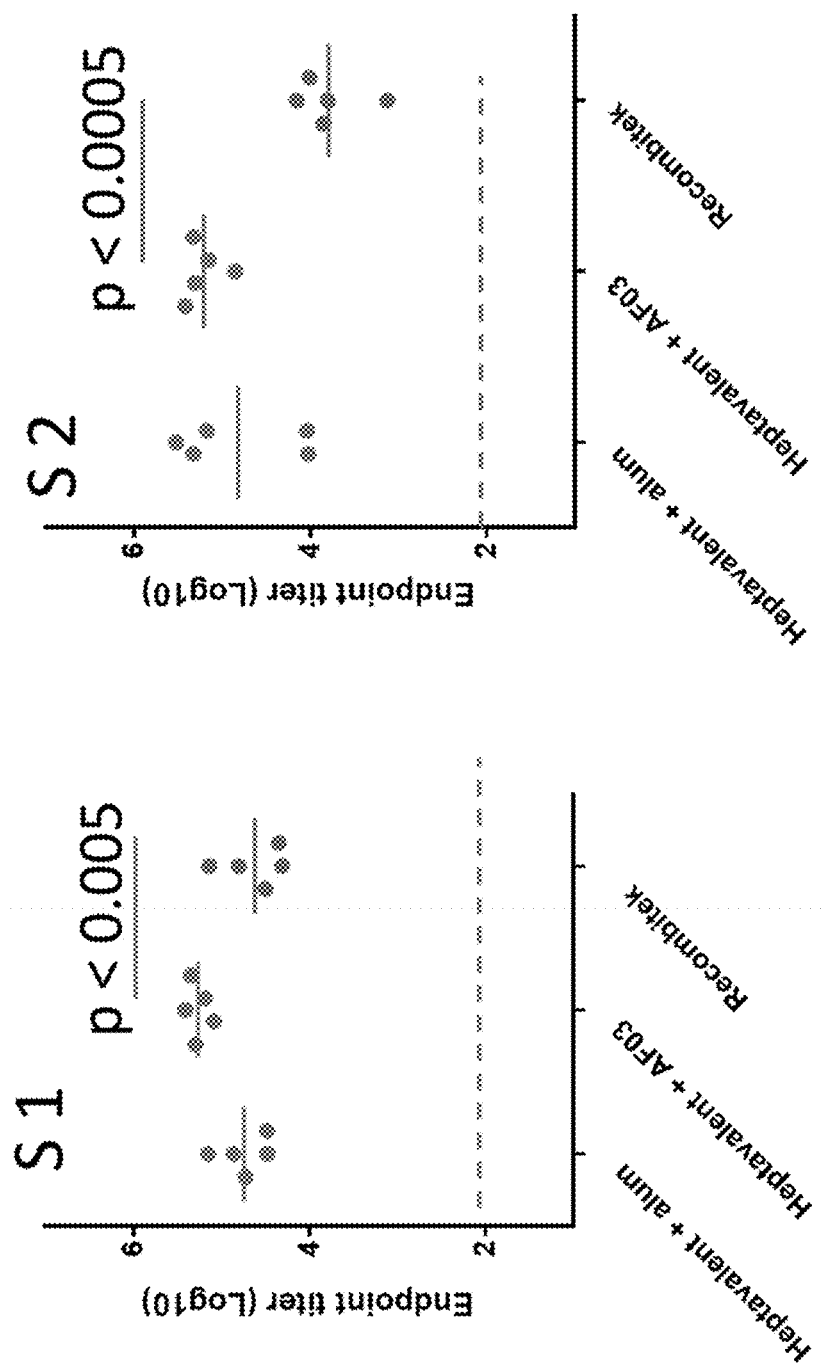
FIG. 24A-24G show antibody responses to serotypes 1-7, respectively, in C3H mice (n=5 per group) to heptavalent OspA-ferritin nanoparticle compositions of 1 ug each of OspA-ferritin nanoparticles corresponding to OspA serotypes 1-7 (total 7 ug) adjuvanted with either alum or AF03, or to RECOMBITEK® Lyme. For all experiments, an ELISA plate was coated with the OspA serotype indicated in each panel as "S X" where X is the serotype number.
Figure 24D:
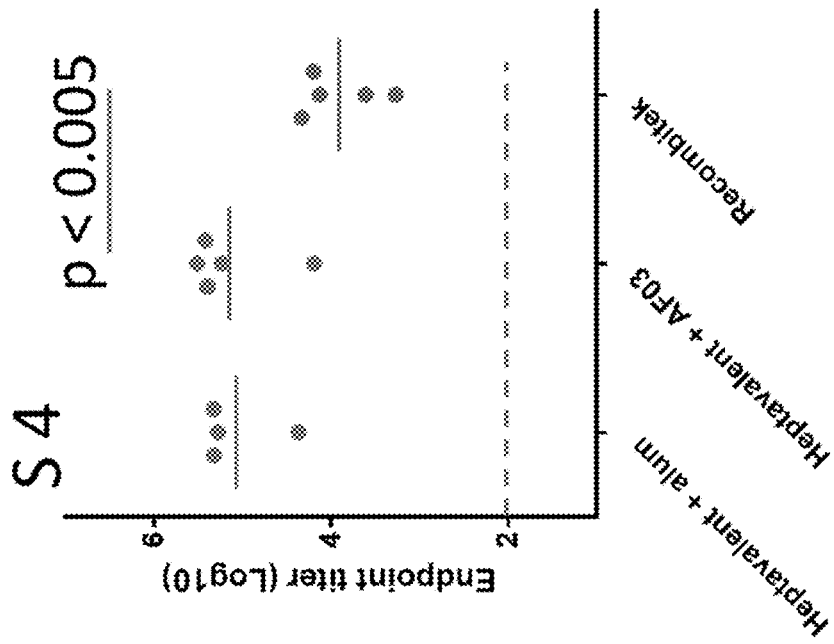
Figure 24C:
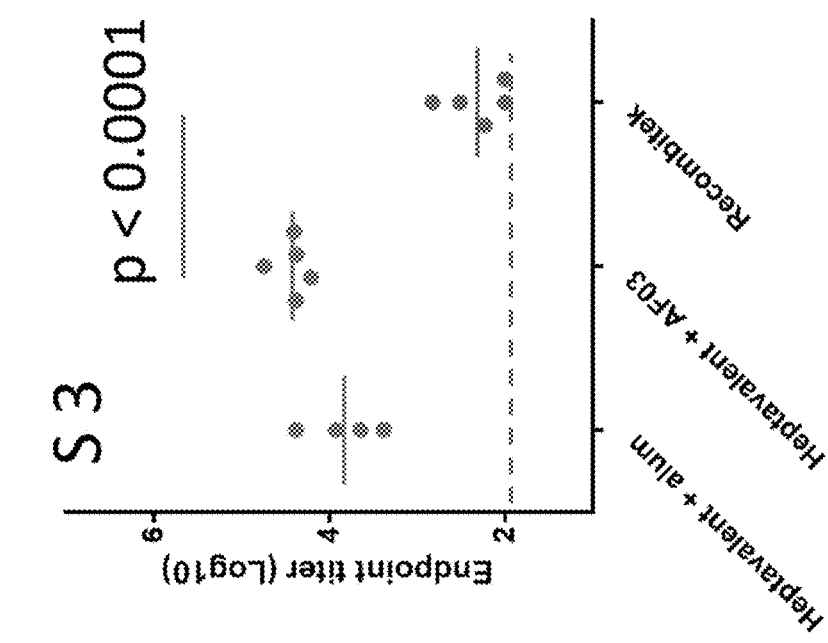
Figures 24E, 24F:
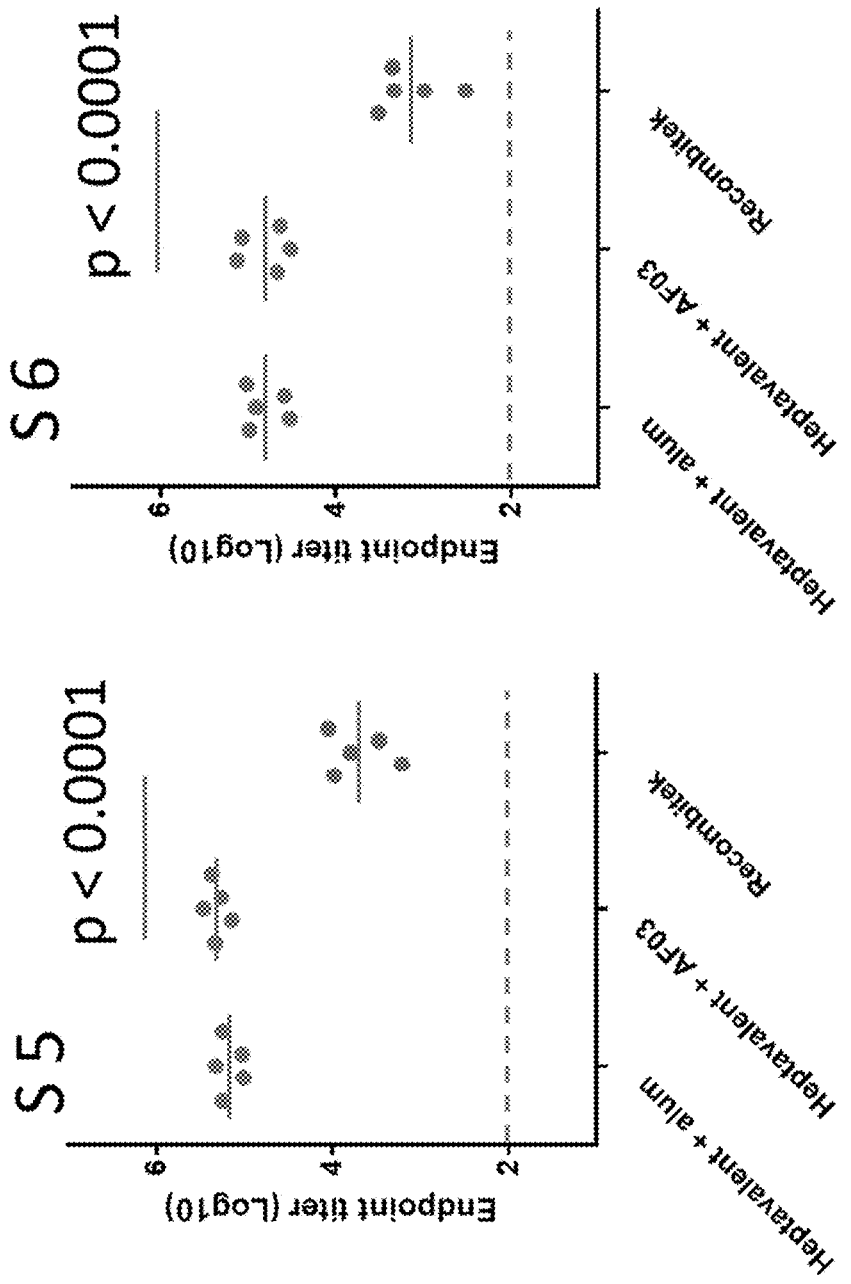
Figure 24G:
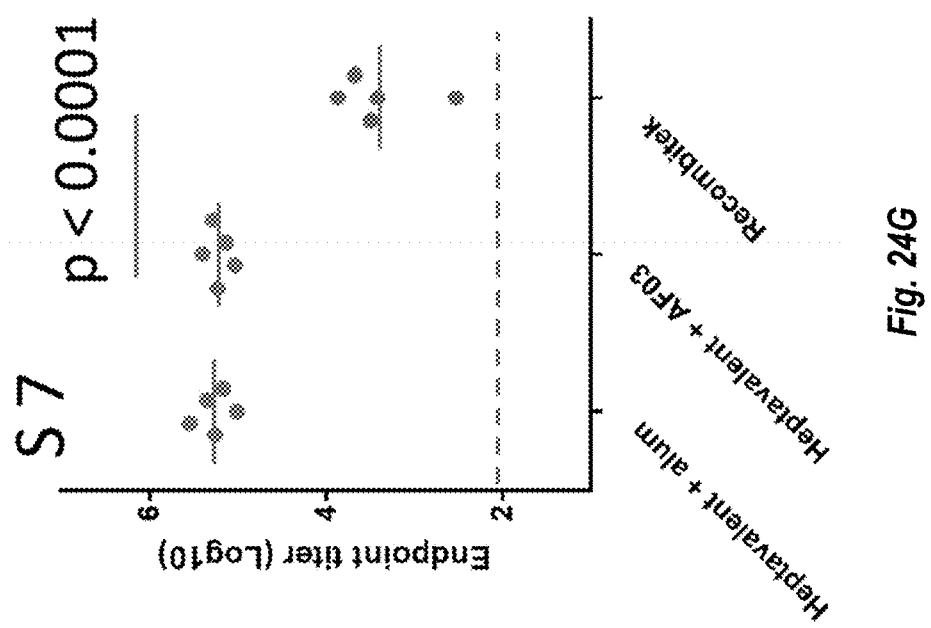

Another nanoparticle, lumazine synthase from *Aquifex aeolicus*, was investigated for antigenic display of OspA. OspA-lumazine synthase particles comprising different serotypes were purified easily from *E. coli* cells by anion exchange and size exclusion chromatography. Constructs were generated and characterized that comprised OspA serotype 1 (SEQ ID NO: 12, FIGS. 19A-19C); OspA serotype 2 (SEQ ID NO: 16, FIGS. 20A-20C); OspA serotype 3 (SEQ ID NO: 17, FIGS. 21A-21B); OspA serotype 4 (SEQ ID NO: 18, FIGS. 17A-17C); OspA serotype 5 (SEQ ID NO: 19, FIGS. 22A-22C); and OspA serotype 7 (SEQ ID NO: 21, FIGS. 23A-23C). The OspA-lumazine synthase particles formed a 15.8 nm particle by EM and were uniform in size by DLS.

Figure 18:
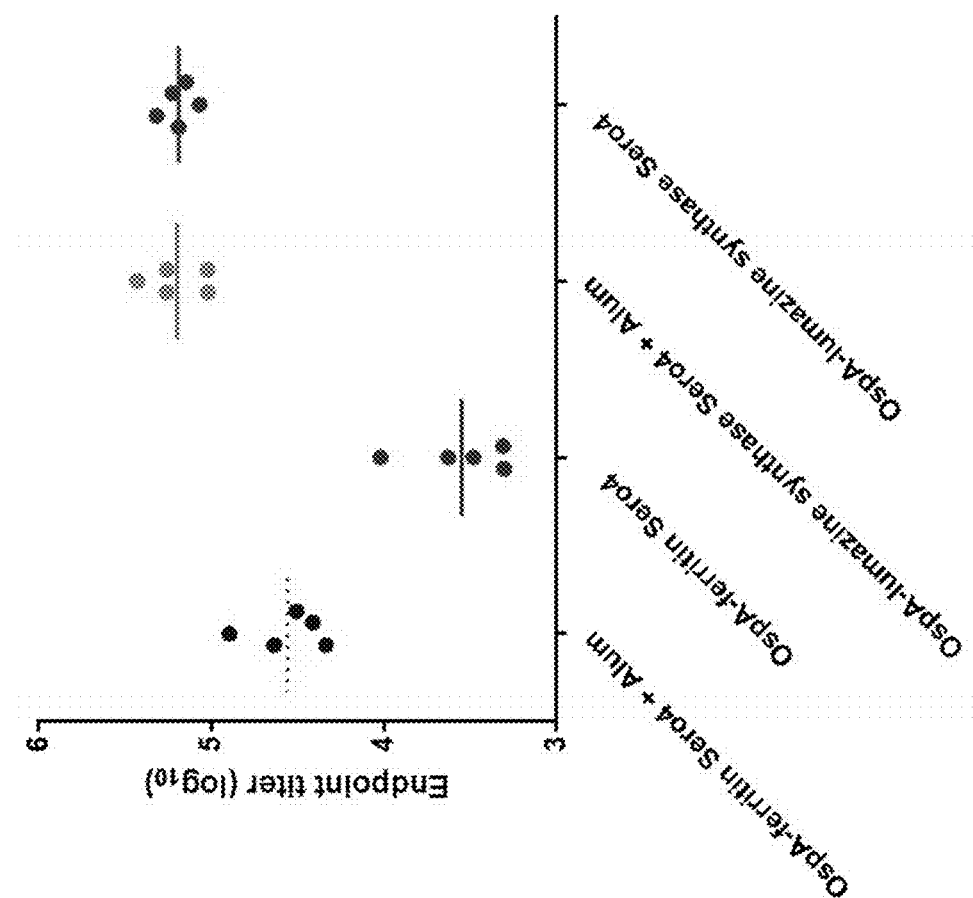
FIG. 18 shows antibody response in mice to a OspA serotype 4-ferritin construct (SEQ ID NO: 4) and an OspA serotype 4-lumazine synthase construct (SEQ ID NO: 18), with or without Alum.

OspA serotype 4 lumazine synthase particles (SEQ ID NO: 18) were tested in mice for immunogenicity (FIG. 18). The OspA lumazine synthase particles with and without Alum gave a strong immune response that appeared at least as robust as that of a similar OspA serotype 4 ferritin nanoparticle (SEQ ID NO: 7).

Thus, antigenic polypeptides comprising lumazine synthase and an OspA polypeptide can also be used to elicit anti-OspA antibody responses.

Figure 27:
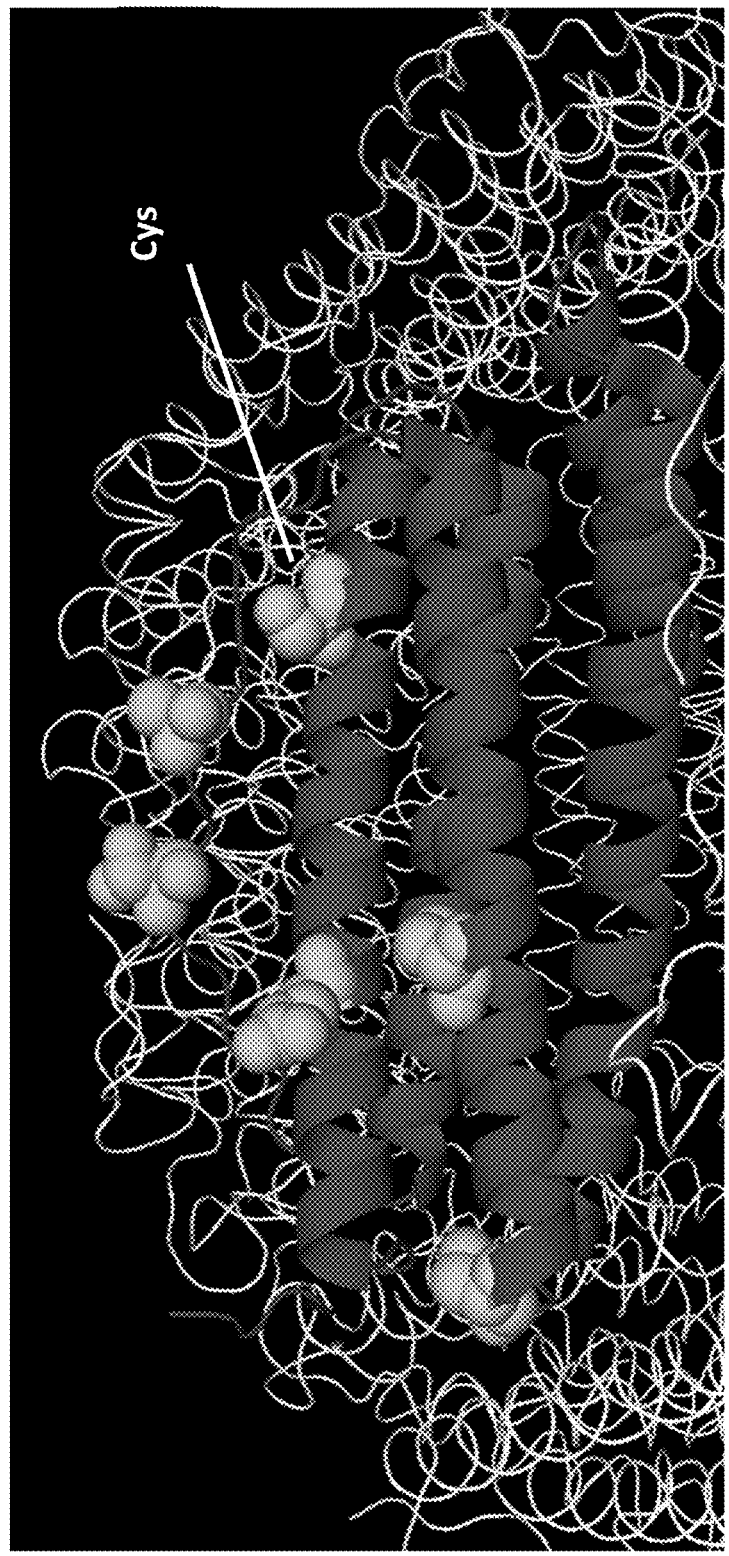
FIG. 27. Engineered surface-exposed cysteine (Cys) on ferritin. The location of a cysteine resulting from a mutation replacing a surface-exposed amino acid is shown in the context of a ferritin nanoparticle.

Example 8: Design, Purification, and Characterization of HA-Ferritin Nanoparticles HA nanoparticles (HA-Nps) were generated by fusing HA ectodomain sequences (lacking 48 C-terminal transmembrane residues) to the N-terminus of a ferritin to produce nanoparticles that self-assembled in mammalian cells. The ferritins comprised a mutation replacing a surface-exposed amino acid with a cysteine (resulting from a S26C, A75C, or S111C mutation relative to the ferritin sequence of SEQ ID NO: 208) to allow conjugation of adjuvant onto to HA-Nps. A representation of such a cysteine is presented in FIG. 27.

Figure 28A:
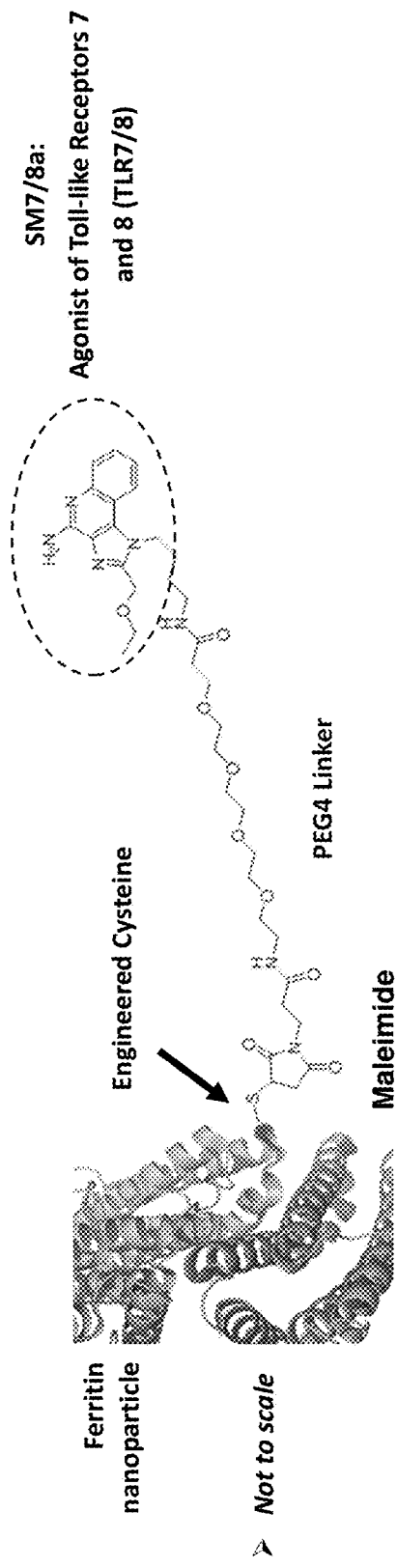
FIGS. 28A-28B. Conjugation of toll-like receptor (TLR) agonists to ferritin.

The cysteine resulting from the mutation described above can be used to conjugate an immune-stimulatory moiety. FIG. 28A illustrates the result of an exemplary 1-step click chemistry reaction to conjugate a TLR agonist to ferritin using a maleimide-PEG4-SM7/8a click reagent. In this reaction, the maleimide reacts with the unpaired cysteine to conjugate the TLR7/8 agonist molecule covalently to the ferritin at surface-exposed cysteine via the intervening linker, yielding a covalent TLR7/8-agonist-ferritin conjugate. In this example, one cysteine on the surface of one monomer is indicated. Ferritin nanoparticles are multimers, e.g., consisting of 24 monomers. Thus, a ferritin nanoparticle can comprise a number of surface-exposed cysteines equal to the number of monomers, and each of the surface-exposed cysteines can be conjugated.

Figure 28B:
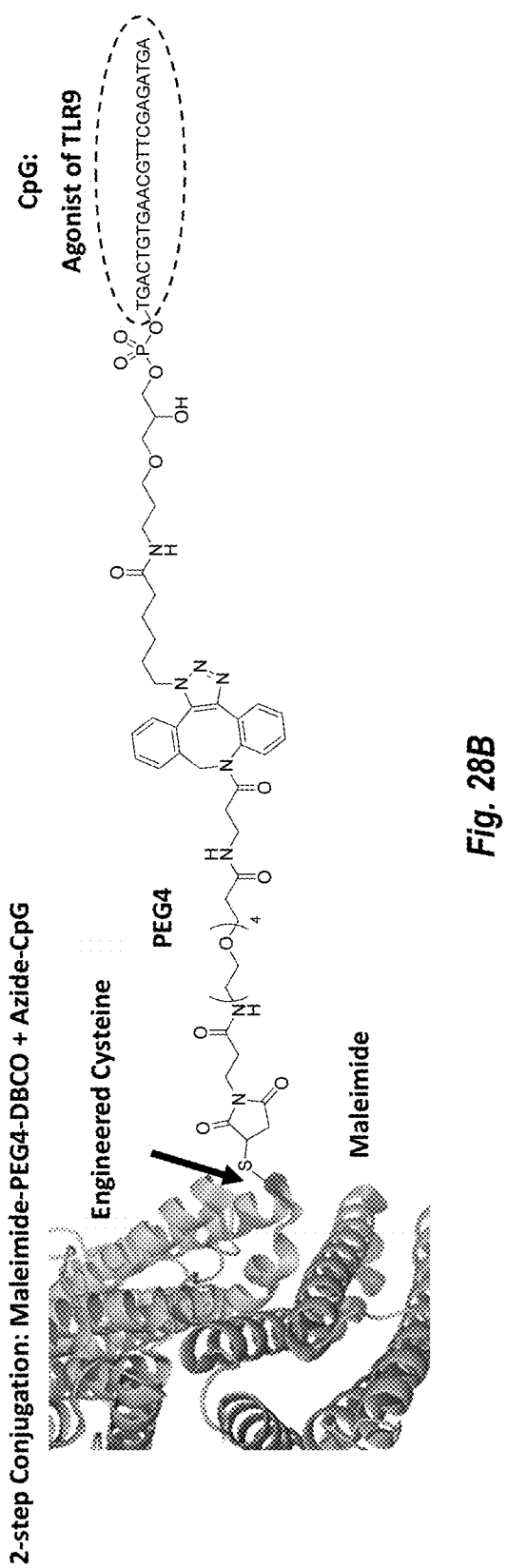
Figure 29A:
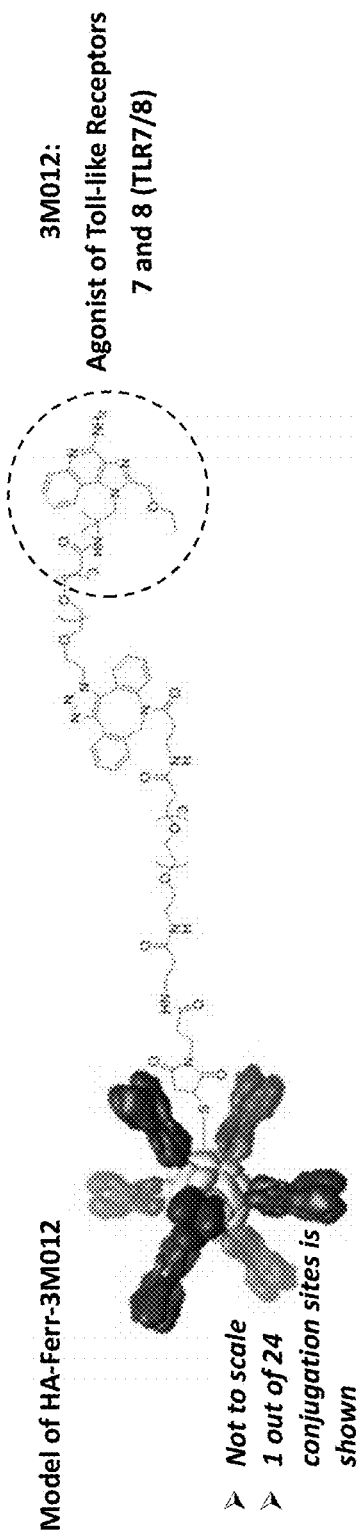
FIGS. 29A-29B. Conjugations of toll-like receptor (TLR) agonists to ferritin.
Figure 29B:
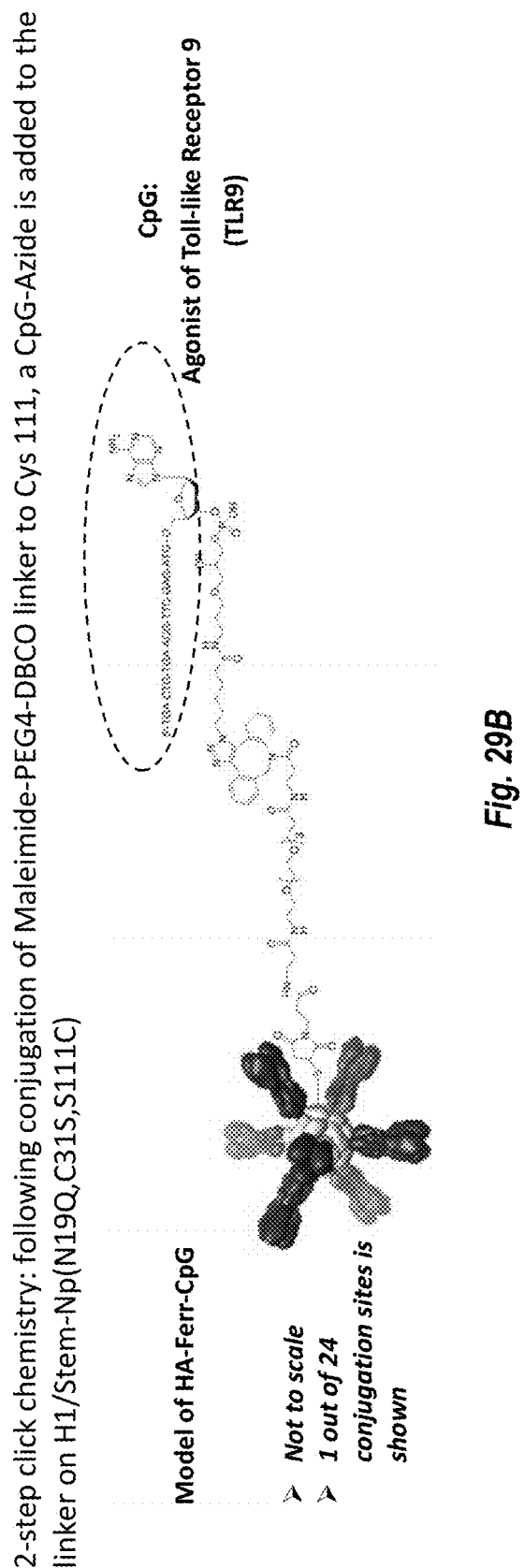

FIGS. 28B and 29A-29B illustrate exemplary 2-step click chemistries that can be used to conjugate adjuvants to ferritin nanoparticles and illustrate how CpG and 3M-012 (sometimes also referred to as 3M012) can also be conjugated to ferritin by 2-step click chemistry reactions via an intermediate bifunctional linker. An exemplary linker is Sigma PEG linker (catalog #760676) which contains the maleimide and DBCO reactive groups. In this example, the TLR agonists are functionalized by a reactive azide group.

Figure 30:
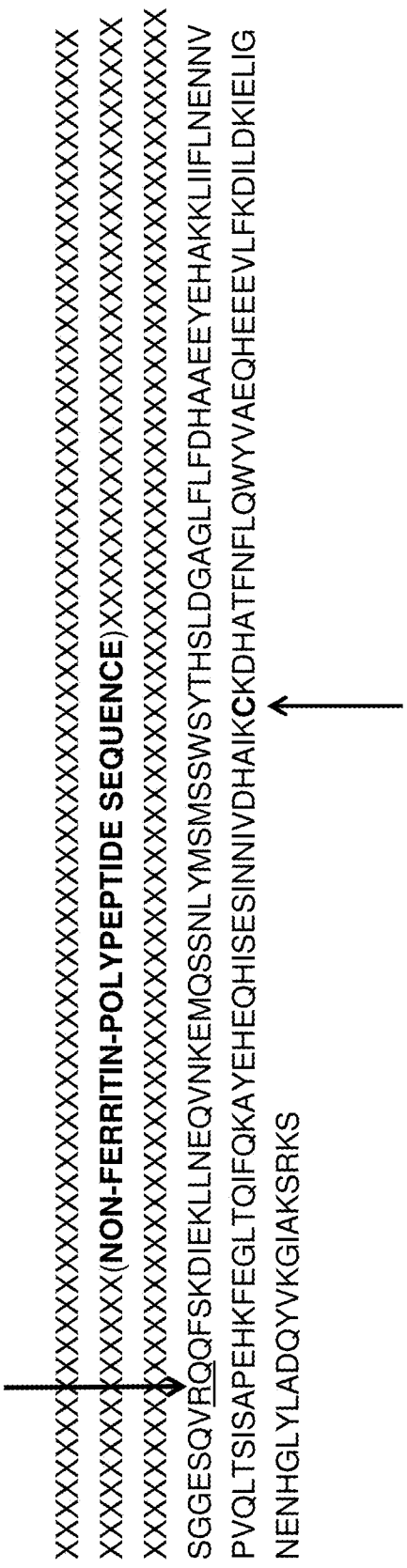
FIG. 30. Trypsin cut site within the ferritin portion of certain ferritin nanoparticle constructs. Some ferritin nanoparticles comprise a trypsin cut site in addition to an unpaired, surface-exposed cysteine for conjugation of an adjuvant. The amino acid sequence presented in FIG. 30 is a "generalized" sequence showing a sequence common to multiple constructs. For example, residues 519-694 of SEQ ID NO: 314 comprises the "generalized" sequence presented in FIG. 30. The "XXX" sequence represents an influenza polypeptide. The location of the ferritin S111C mutation present in this sequence is also indicated.
Figure 32A:
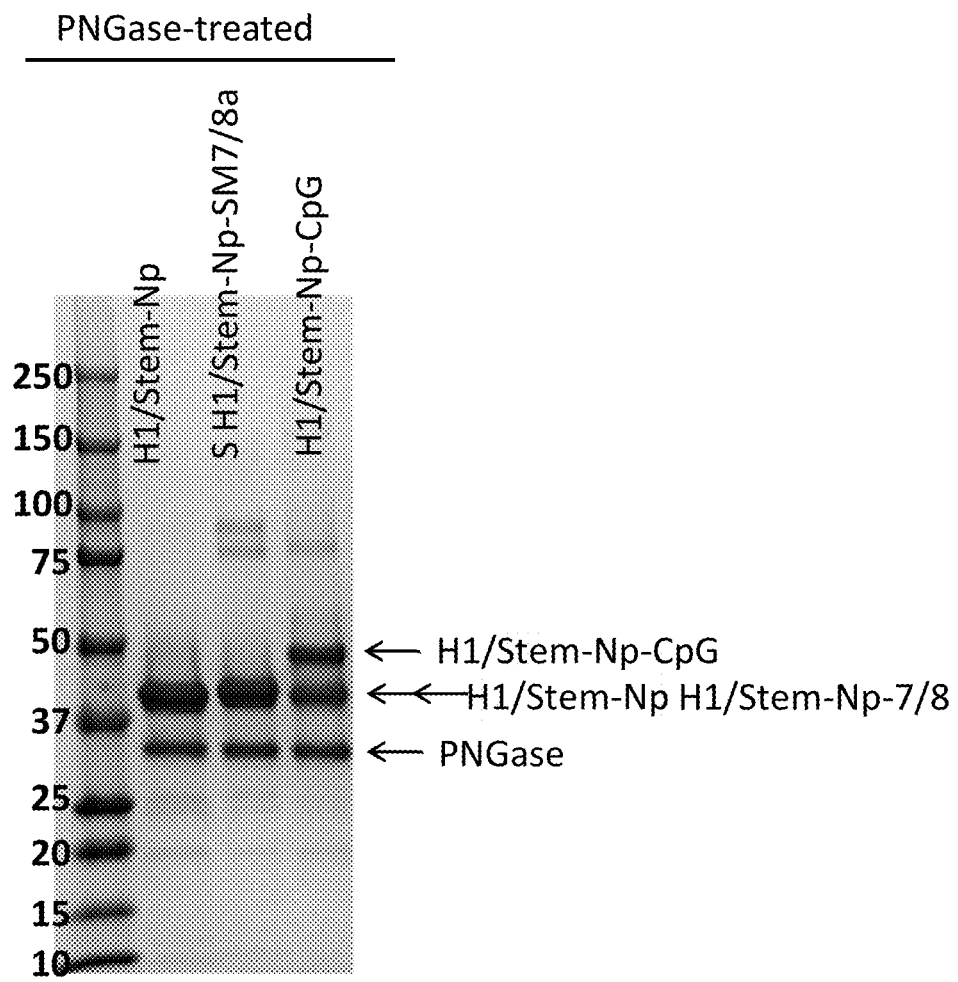
FIGS. 32A and 32B. Further gel-shift results with or without conjugation.
Figure 32B:
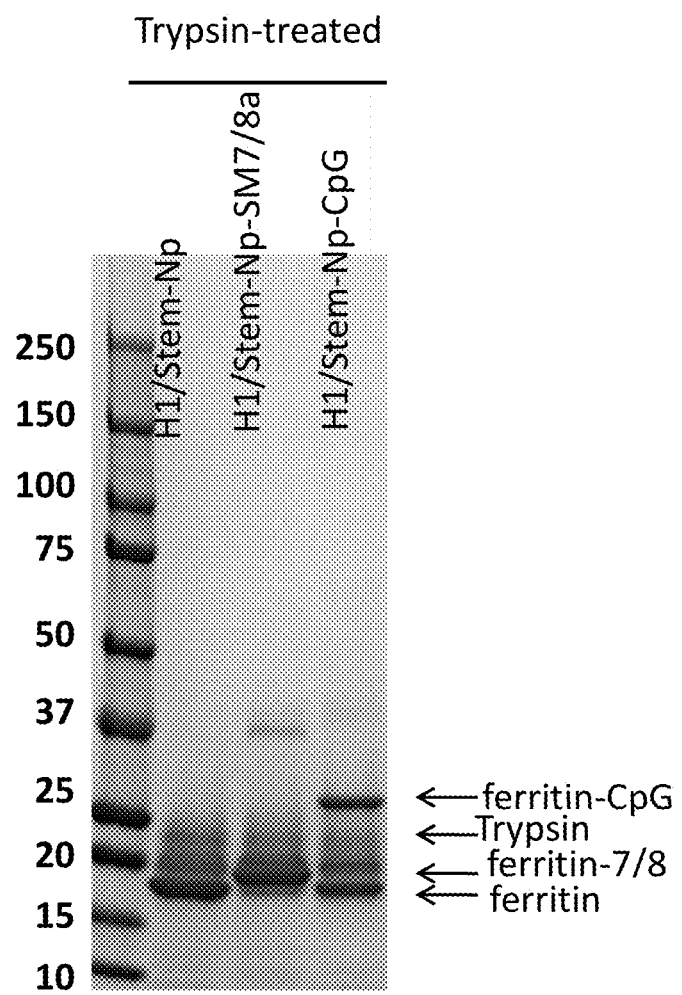

Mass spectrometry (MS) is used in experiments described below to characterize influenza-ferritin with and without conjugated immune-stimulatory moieties. The analyte subjected to MS was in some cases a trypsin digest of the influenza-ferritin. Trypsin generally cuts after lysine and arginine residues, except when followed by a proline. The structured nanoparticle (C-terminal to the indicated trypsin site) is resistant to proteolysis, however. The most distal (C-terminal) trypsin site that can be cleaved by trypsin in bullfrog-*H. pylori* ferritin constructs, such as SEQ ID NO: 314, under native conditions is indicated in FIG. 30. Thus, the trypsin digest releases a proteolysis-resistant ferritin particle suitable for MS analysis.

Figure 33A:
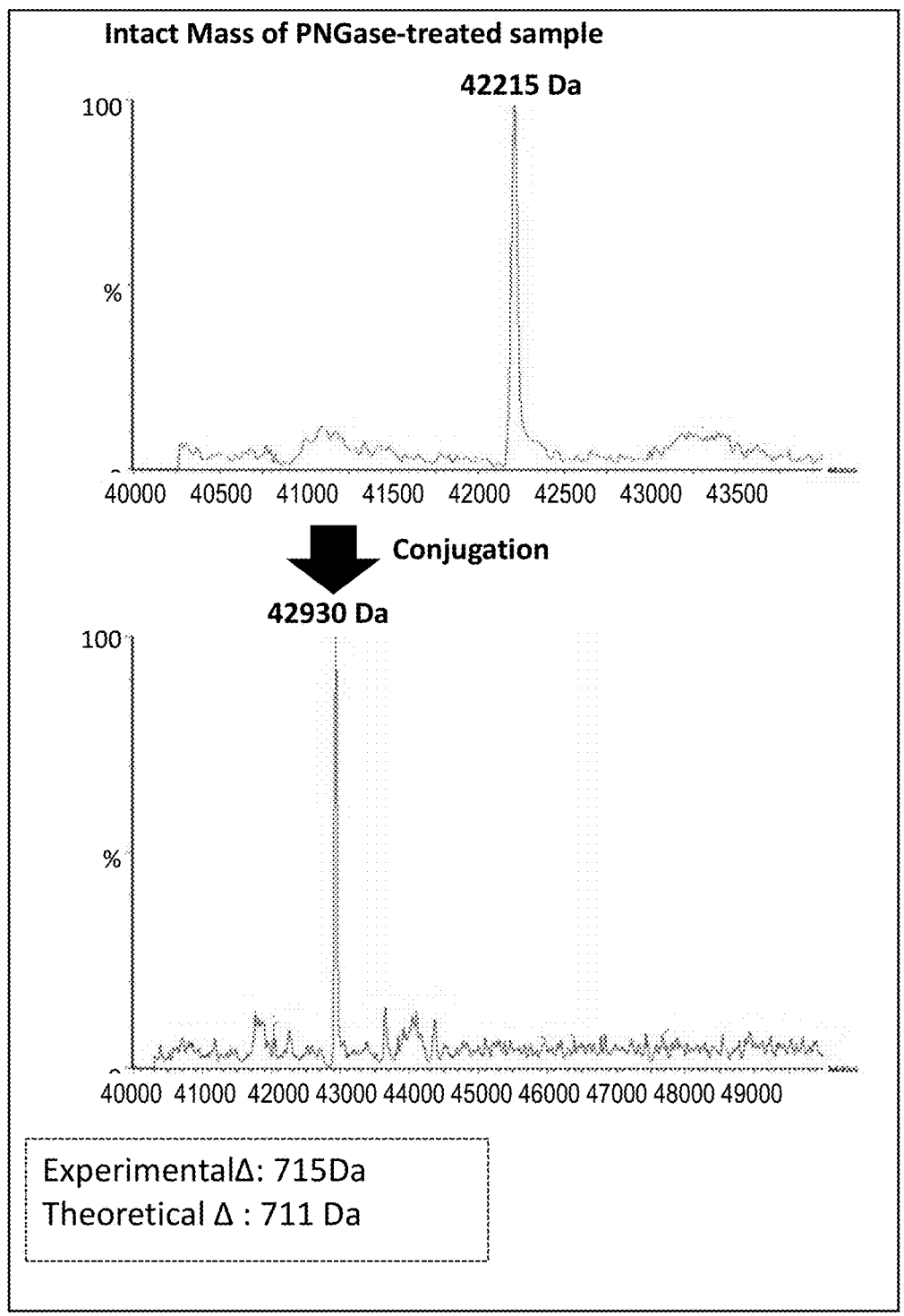
FIGS. 33A and 33B. Mass spectra with or without conjugation of maleimide-PEG4-SM7/8a to H1/Stem-Np.

Thus, trypsin digestion followed by a simplified MS analysis regardless of the N-terminal antigen present in the uncleaved polypeptide can be used to evaluate conjugation to the nanoparticle, given that the linker sequence is accessible to Trypsin. This method was devised to overcome the complexity that glycoprotein antigens pose to MS analysis. For example, the H1/Stem-Np can otherwise be analyzed by MS only after PNGase-treatment (FIG. 33A).

Figure 33B:
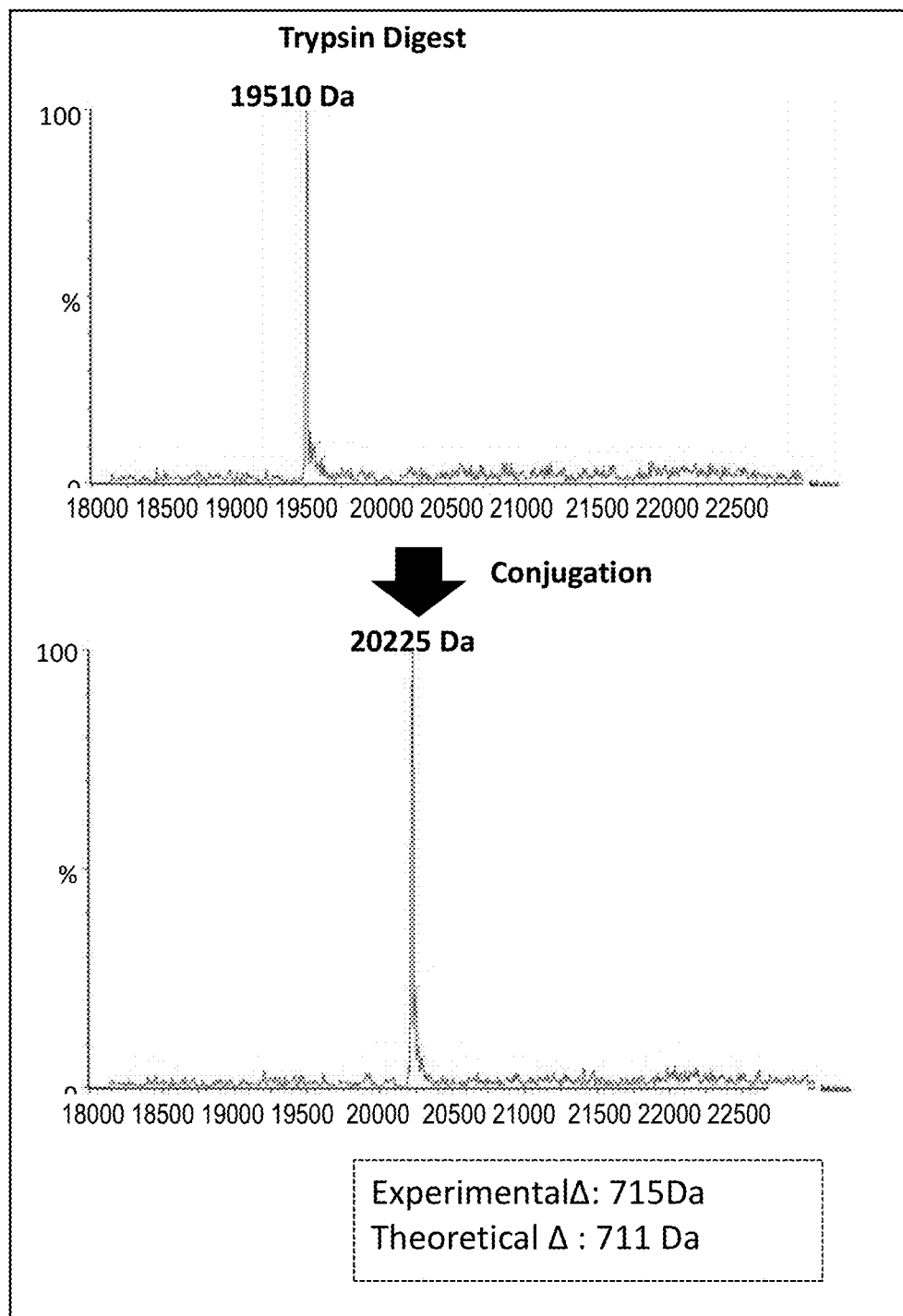

HA sequences from the following influenza strains were genetically fused to the N-terminus of *Helicobacter pylori*-bullfrog hybrid ferritin to construct the HA-nanoparticles: A/Fort Monmouth/1-JY2/1947 (GenBank CY147342, amino acids 1-518, Y108F); A/Malaysia/302/1954 (GenBank CY009340.1, amino acids 1-518, Y108F); A/Denver/1957 (GenBank CY008988, amino acids 1-517, Y108F); A/Hong Kong/117/1977 (GenBank CY009292, amino acids 1-518, Y108F); A/New Caledonia/20/99 (GenBank AHJ09883.1, amino acids 1-518); A/California/4/2009 (GenBank AHJ09884.1, amino acids 1-518); COBRA P1 (SEQ ID NO: 302 in US patent publication US20150017196A1, amino acids 1-518, Y108F) and COBRA X6 (US patent publication US20140127248A1, amino acids 1-517, Y108F). COBRA P1 and COBRA X6 were generated through a computational method of hierarchical sequence averaging (Carter D M, et al., J Virol 90:4720-4734 (2016)). COBRA X6, was generated from human H1N1 influenza sequences spanning 1999-2012, and COBRA P1 from human H1N1 strains spanning 1933-1957 and 2009-2011 plus swine H1N1 influenza strains from 1931-1998 (Carter 2016). The HA-ferritin genes were cloned into the XbaI/BamHI sites of SIB002 vector for mammalian expression, with a gccacc kozak sequence in front of the ATG start codon. All sequences were codon-optimized for expression in human cell lines.

HA-Np plasmids were purified with the Powerprep kit (Origene catalog #NP100009) and used to transfect Expi293 cells (ThermoFisher catalog #A14635). The FectoPRO DNA transfection reagent (Polyplus #116-100) was used with standard conditions (0.5 μg of DNA/mL, 0.75 μl FectoPRO reagent/mL and 0.45 μl of enhancer/mL). Nanoparticles were harvested from Expi293 supernatant by centrifugation at 3,488 g for 15 min at 4 degrees, 4-6 days after transfection and filtered through a 0.45 μm vacuum-driven filter unit (Thermo Scientific catalog #167-0045). HA-Nps were passed through a Q-Sepharose Fast flow column (GE catalog #17051001) by gravity-flow and the flow-through was collected and diluted 3× with water, and pH was adjusted by adding Tris buffer pH 8.5 at a final concentration of 50 mM; or supernatants were diluted 5× with Buffer A (50 mM Tris pH 8.5, 5 mM NaCl) instead of using the initial Q-Sepharose column. The samples were then loaded to a Q-Sepharose column (HiTrap Q HP, GE catalog #17115401) and proteins were eluted over a NaCl gradient, with 0-60% mixing of buffer A (50 mM Tris pH 8.5, 5 mM NaCl) and buffer B (50 mM Tris, pH 8.5, 1 M NaCl) over 30 column volumes. The HA-nanoparticle protein fractions were collected and concentrated with Amicon Ultra-15 centrifugal filter unit (Millipore catalog #UFC910024) and further purified by size exclusion chromatography with a Superose 6 column PG XK 16/70, 60-65 cm (catalog ##:90100042) in phosphate buffered saline. The final fractions were concentrated and filter-sterilized through 0.22 μm filter (Millipore SLGV004SL). Endotoxin-free solutions were used, and final proteins were tested using the Charles Rivers Endosafe PTS instrument with LAL cartridges with 0.05 EU/ml limit of detection.

Trypsin digestions of H1/Stem-Np (SEQ ID NO: 343, FIG. 31A) and H5/COBRA-Np (SEQ ID NO: 332, FIG. 31B) are shown. In both cases, the shift in molecular weight with trypsin digestion (indicated by "+") corresponded to the molecular weight of SM7/8a (711 daltons). Thus, these data indicate successful conjugation of SM7/8a to ferritin nanoparticles comprising a surface-exposed cysteine.

Resolution of the change in weight of ferritin nanoparticles after conjugation to molecules of low molecular weight such as maleimide-PEG4-SM7/8a is not clear in gel-shift experiments (FIG. 32A) using PNGase to remove glycosylation of H1/Stem-Np, without trypsin treatment. As shown in FIG. 32B, trypsin treatment allows confirmation of conjugation of small molecules, such as SM7/8a, to H1/Stem-Np by gel-shift assay. Conjugations of molecules of higher molecular weight, such as CpG, can be observed by gel-shift assay of the deglycosylated H1/Stem-Np (FIG. 32A), and also by gel-shift assay of the ferritin nanoparticle released from H1/Stem-Np by trypsin digestion under native conditions. Thus, use of trypsin digestion of ferritin nanoparticles under native conditions provides a method for the characterization of the core fragment to which TLR agonists are conjugated, as a platform technology, that might otherwise be difficult to analyze with gel-shift or mass spectrometry (MS) experiments on a given antigen with properties can interfere with these analytical assays.

After conjugation of SM7/8a-PEG4-maleimide to the H1/Stem-Np, and PNGase-treatment for analytical purposes only, a conjugation product on MS was seen with a mass of 42930 Da that was approximately 715 kDa heavier than the unconjugated H1/Stem-Np (FIG. 33A). After trypsin digestion, the reduced ferritin nanoparticle had a weight of 19510 Da (based on cleavage of the H1/Stem portion of the nanoparticle) (FIG. 33B). After conjugation, the weight of the trypsin-digested conjugated nanoparticle was also approximately 715 kDa heavier. Thus, both FIG. 33A and FIG. 33B support a conjugation efficiency of about 100% in conjugating a linker comprising adjuvant to the ferritin nanoparticle.

Figure 34:
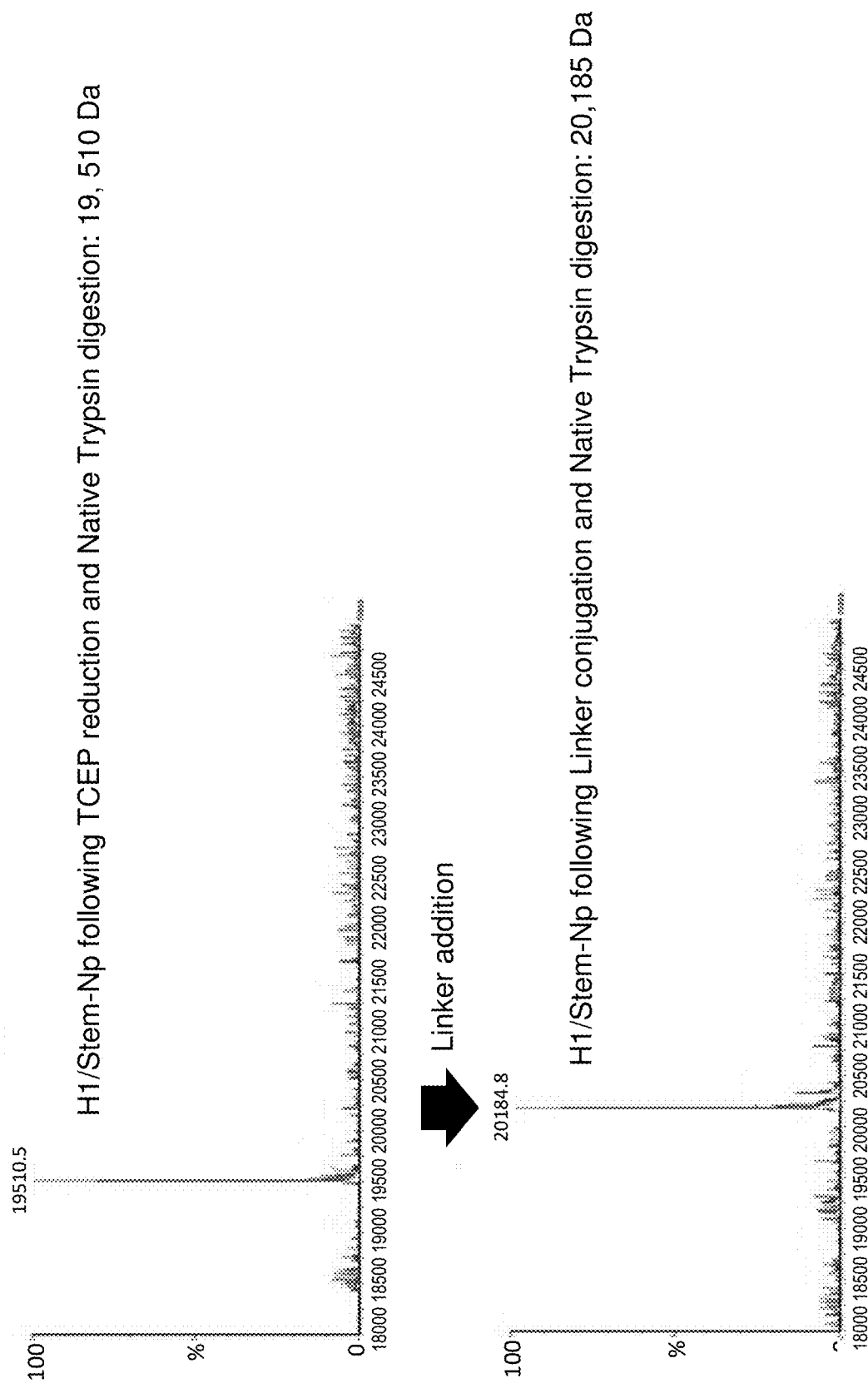
FIG. 34. Mass spectra with or without conjugation of a maleimide-PEG4-DBCO linker to H1/Stem-Np. Maleimide-PEG4-DBCO Linker addition to H1/Stem-Np was confirmed by mass change measured by MS after linker addition.

A maleimide-PEG4-DBCO linker was conjugated to H1/stem-Np in a 2-step click chemistry reaction, in which the maleimide reacted with the surface-exposed cysteine on the ferritin nanoparticle, an increase in weight consistent with the molecular weight of the linker addition, approximately 675 Da, was seen by MS analysis after trypsin digestion (FIG. 34).

Figure 35:
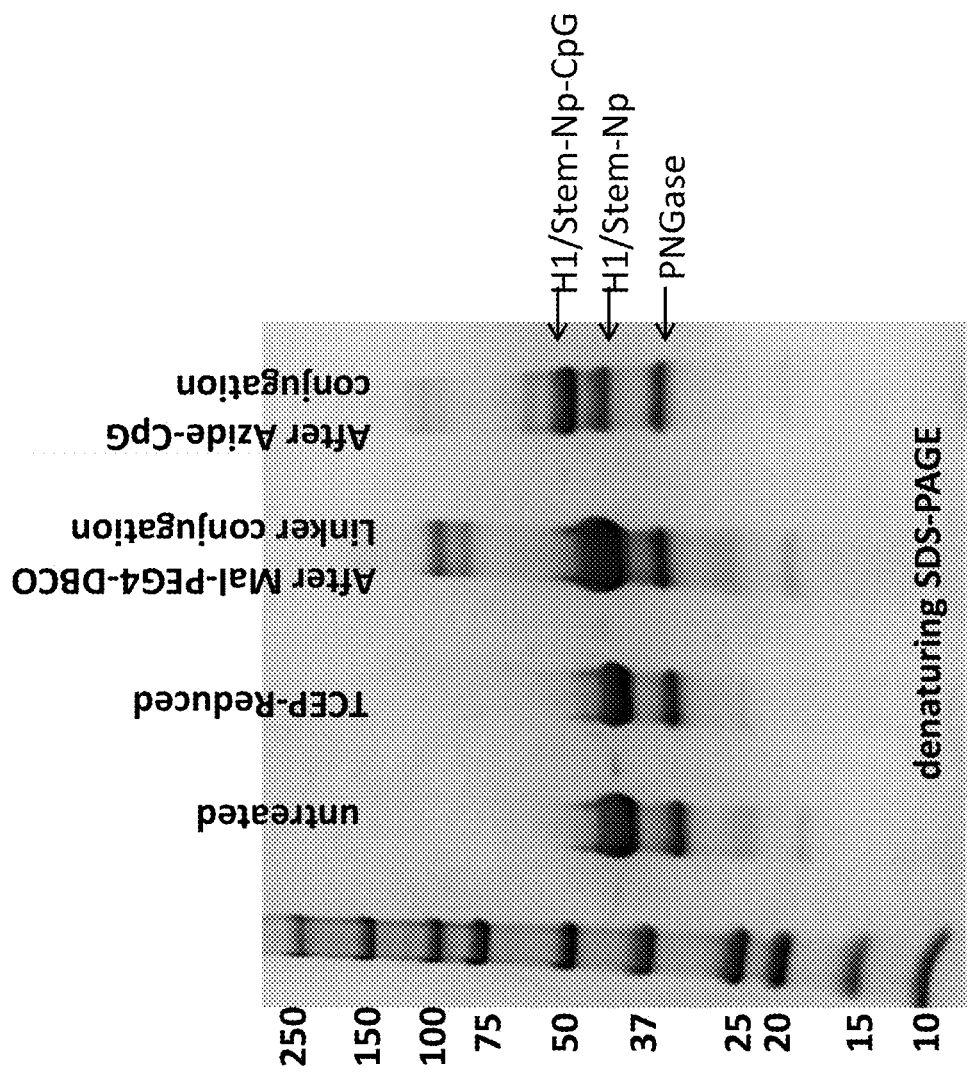
FIG. 35. SDS-PAGE of H1/Stem-Np before and at various stages of conjugation of CpG by 2-step click chemistry. "After azide-CpG conjugation" refers to the final product of the 2-step click reaction.
Figure 36:
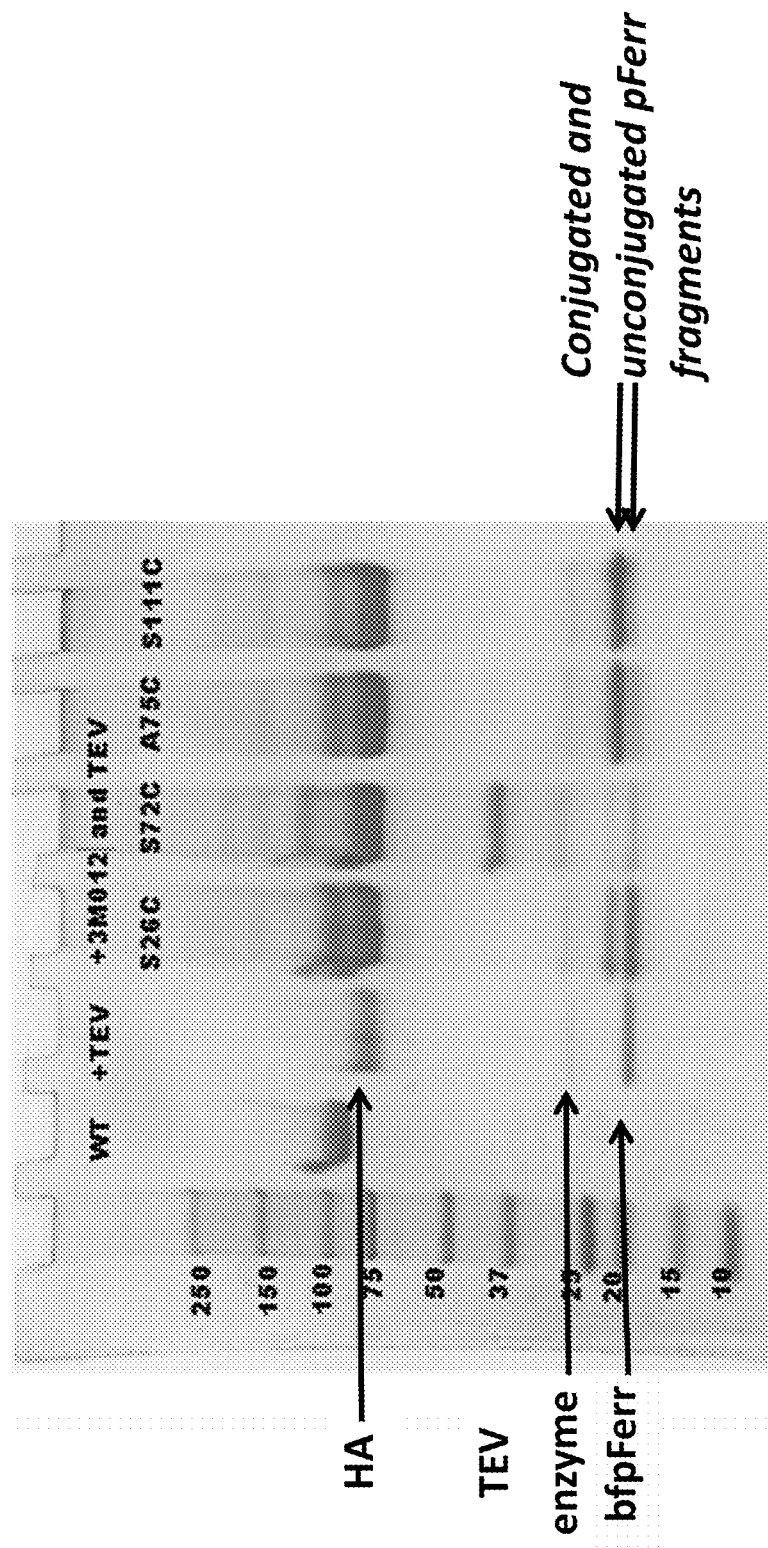
FIG. 36. Characterization of conjugation of a linker comprising 3M-012 to NC99 HA-TEV-Np constructs. The construct in the WT and +TEV lanes had the sequence of SEQ ID NO: 313; S26C refers to SEQ ID NO: 310; S72C refers to SEQ ID NO: 311; A75C refers to SEQ ID No: 312; and S111C refers to SEQ ID NO: 309. All samples except WT were treated with tobacco etch virus protease (TEV).
Figures 37A, 37B:
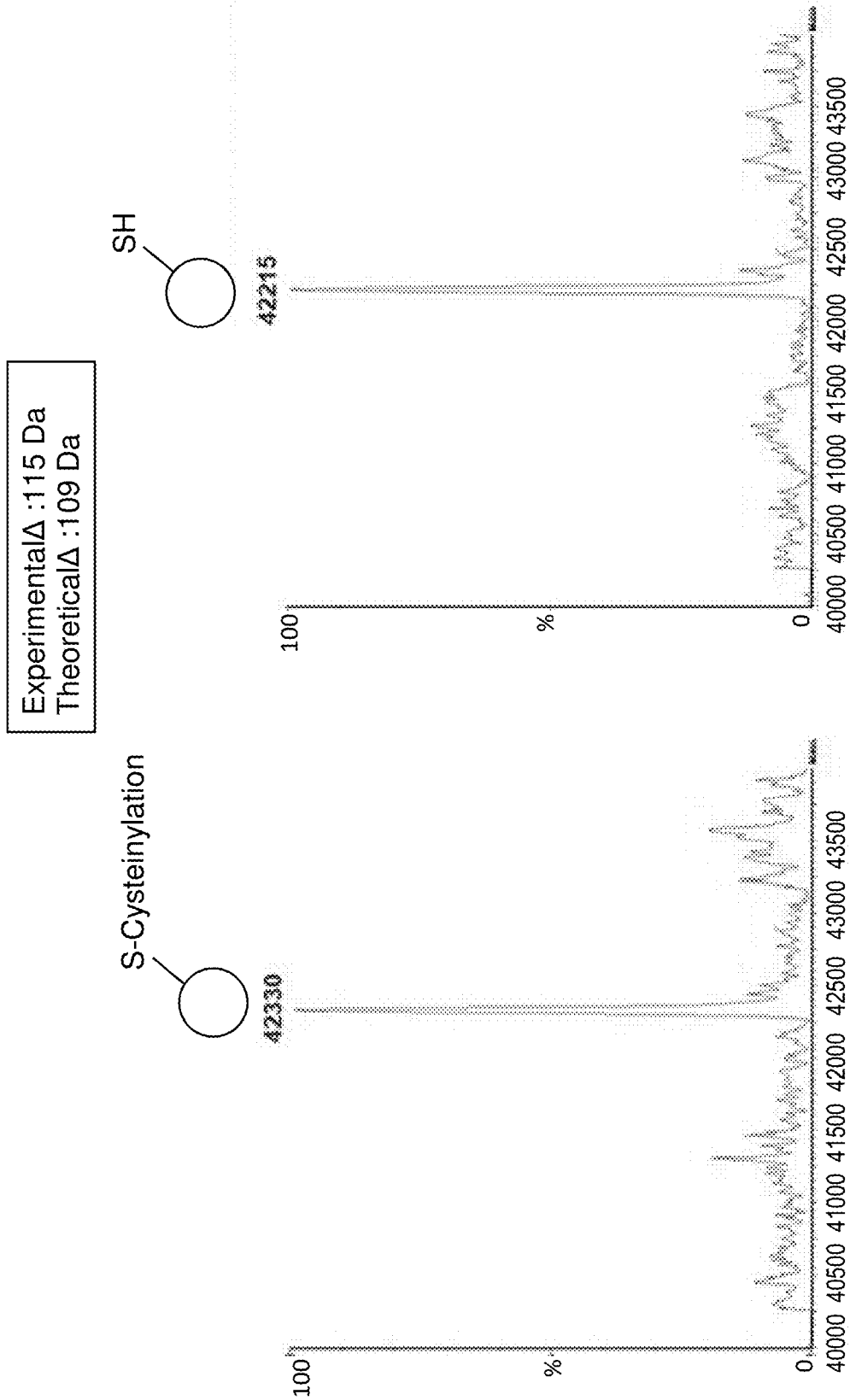
FIGS. 37A-37E. Mass spectra of various constructs with and without reduction or conjugation.
Figure 37C:
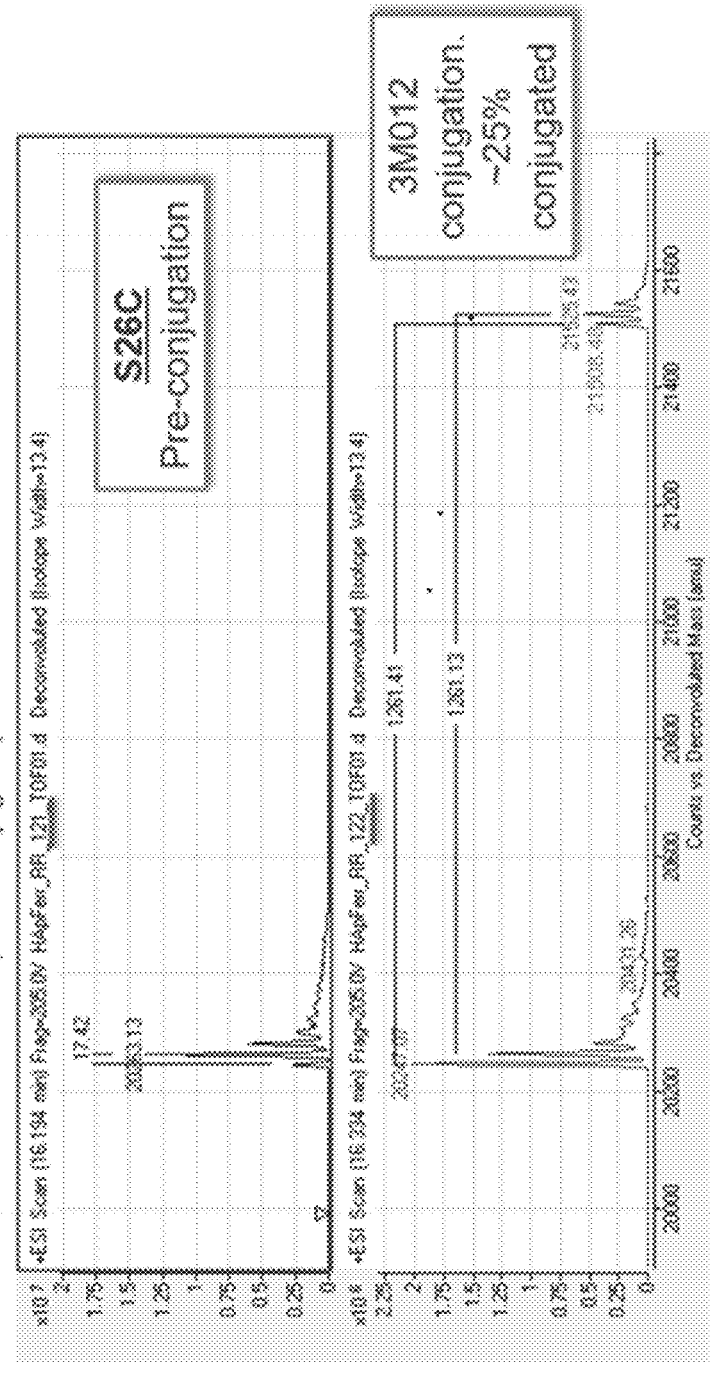
Figure 37D:
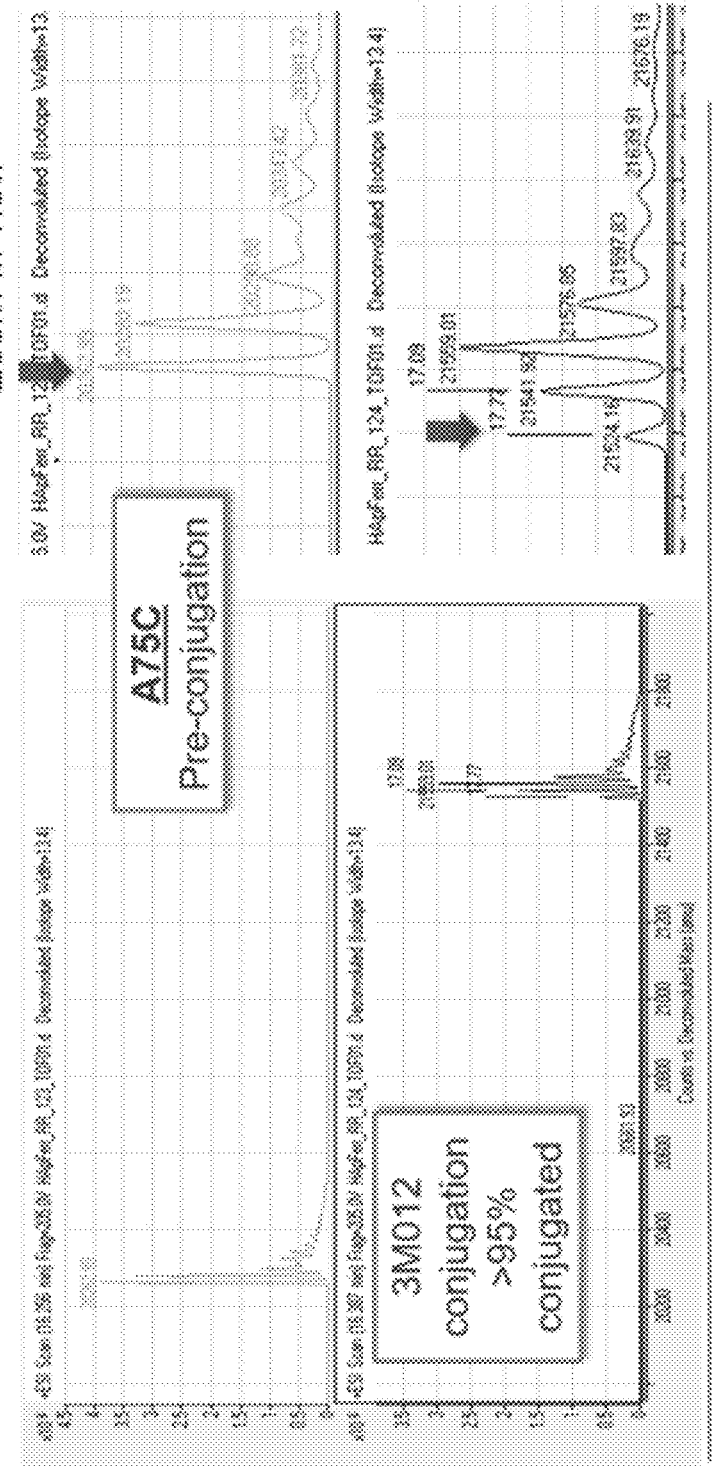
Figure 37E:
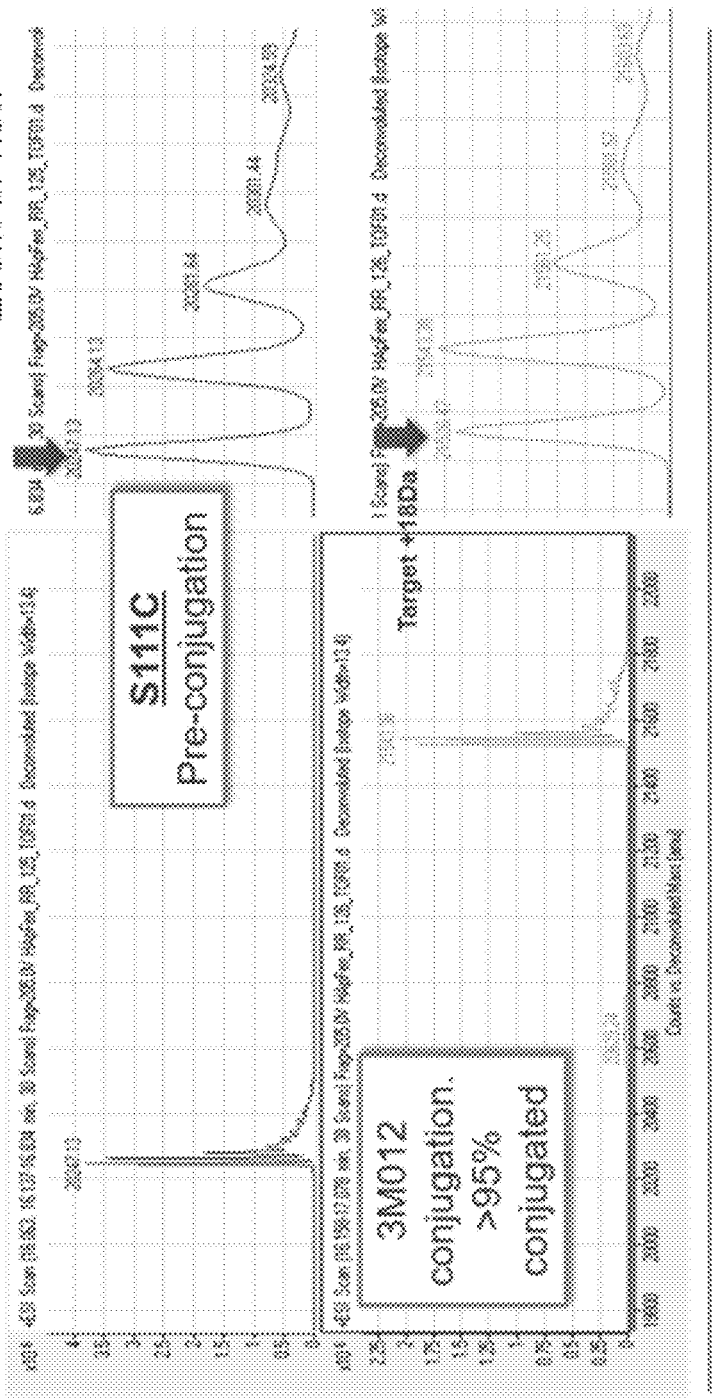
Figures 38D, 38E, 38F:
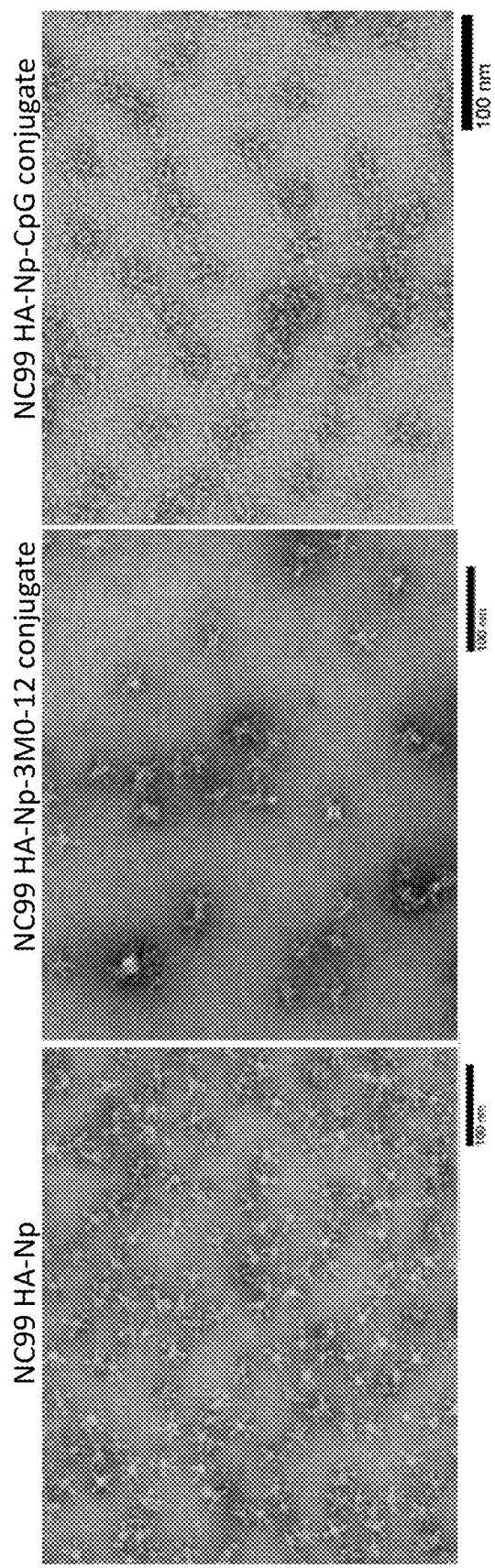
Figure 39A:
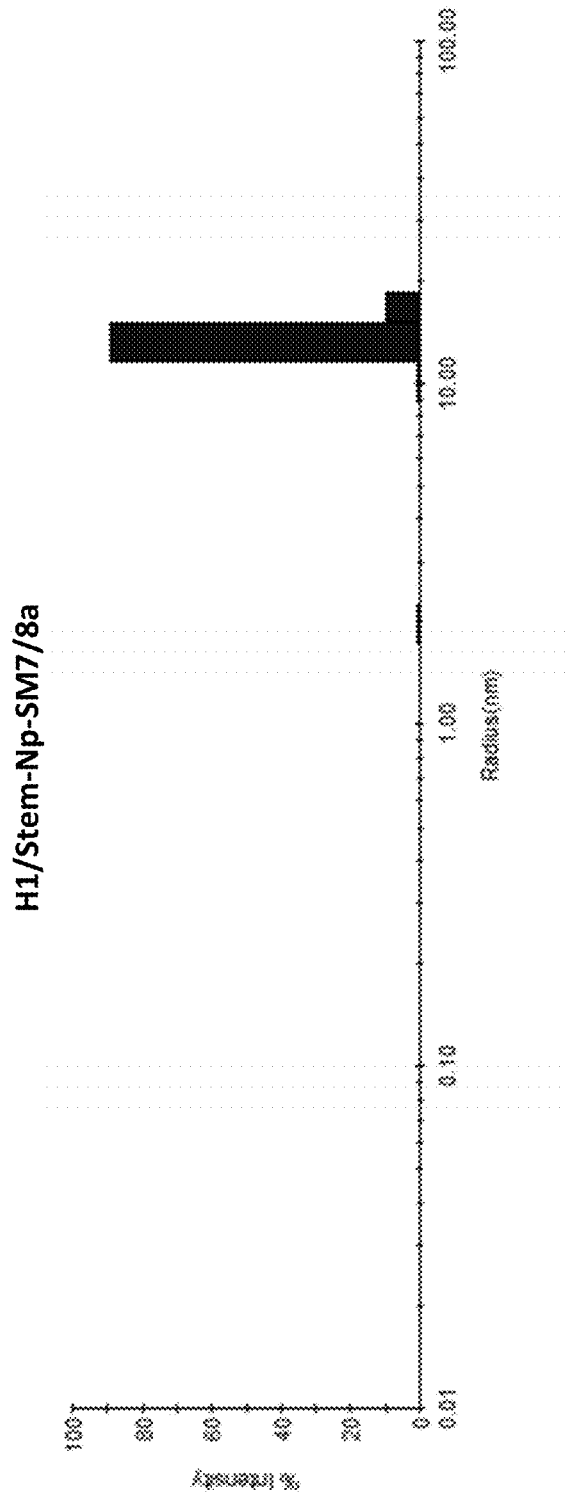
FIGS. 39A-39C. Dynamic light scattering (DLS) analysis of H1/Stem-Np-SM7/8a conjugate (FIG. 39A), H1/Stem-Np-CpG conjugate (FIG. 39B), or unconjugated H1/Stem-Np (FIG. 39C).
Figure 39B:
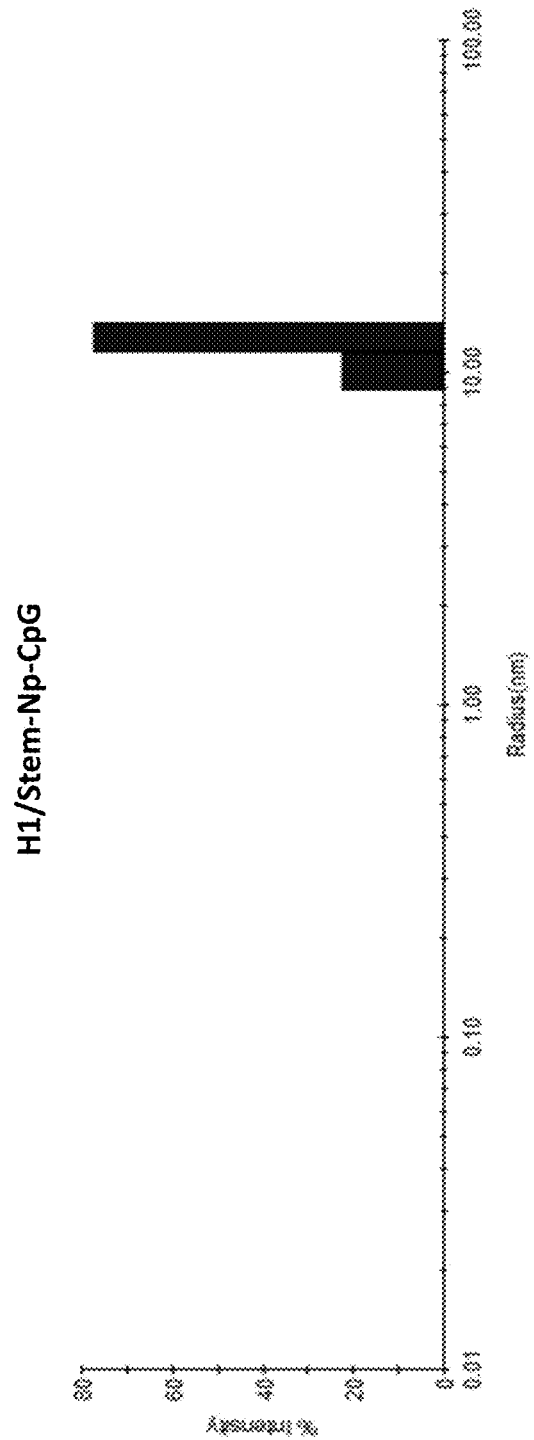
Figure 39C:
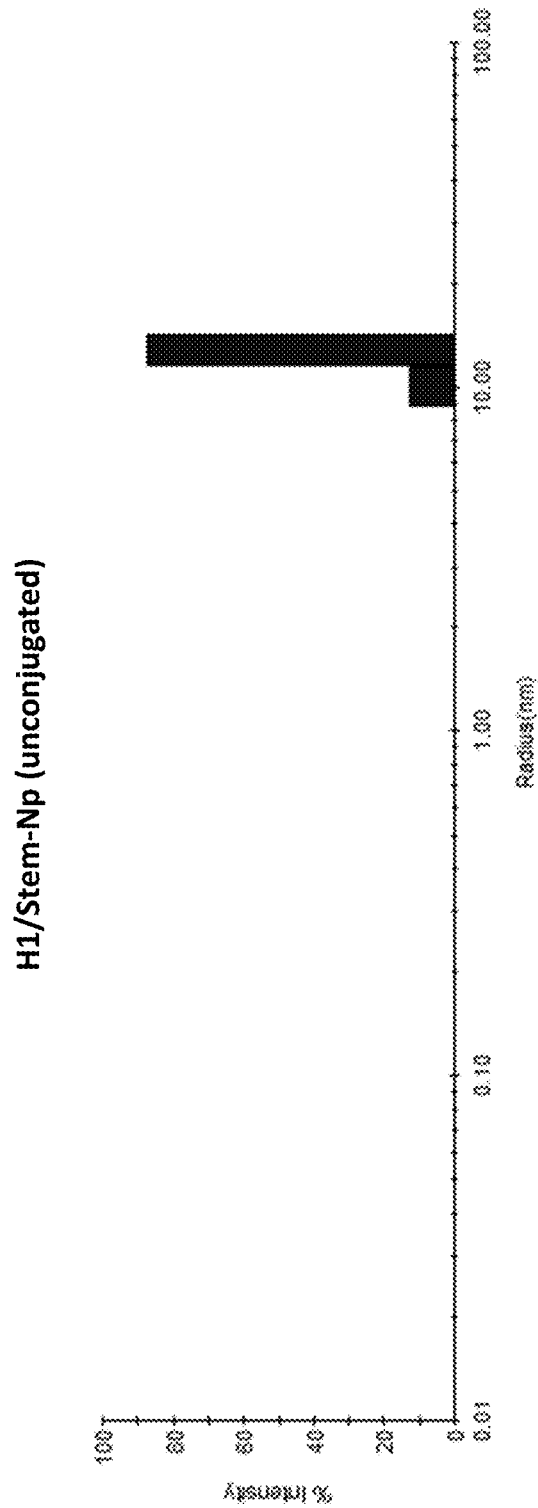
Figure 40A:
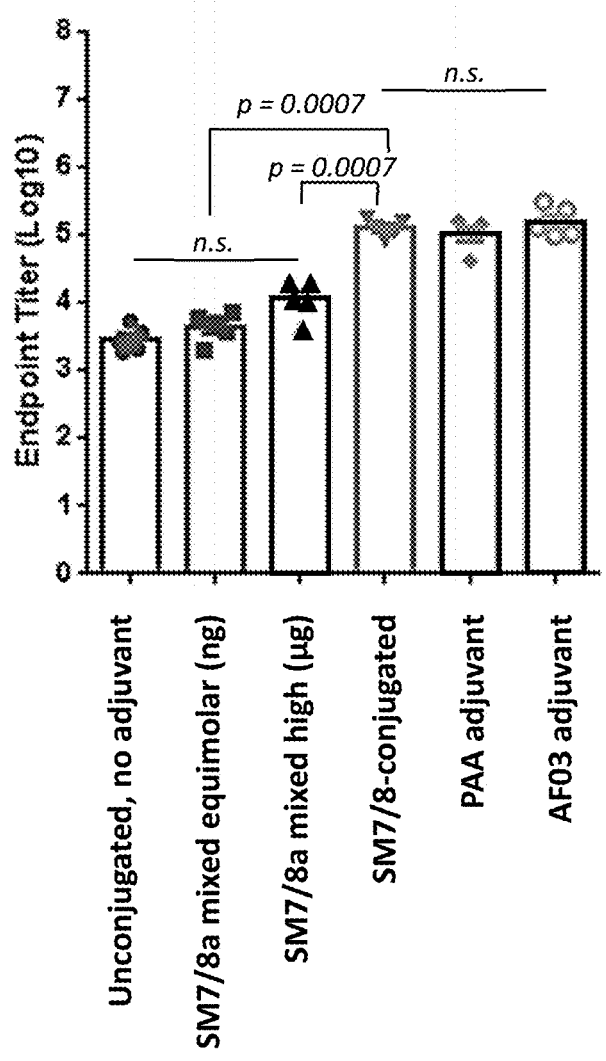
FIG. 40A-B. Antibody response to H1/Stem-Np formulated with admixed adjuvants as indicated, or conjugated to TLR agonists such as SM7/8a or CpG via a PEG4 linker, as shown in FIGS. 28A-B. Serum was collected from mice (n=5) at 5 weeks following immunization (week 0 and week 3), and antibody titers were measured by Enzyme-Linked Immunosorbent Assay (ELISA). This data demonstrates the self-adjuvanting property of the H1/Stem-Np-TLR-agonist conjugates.
Figure 40B:
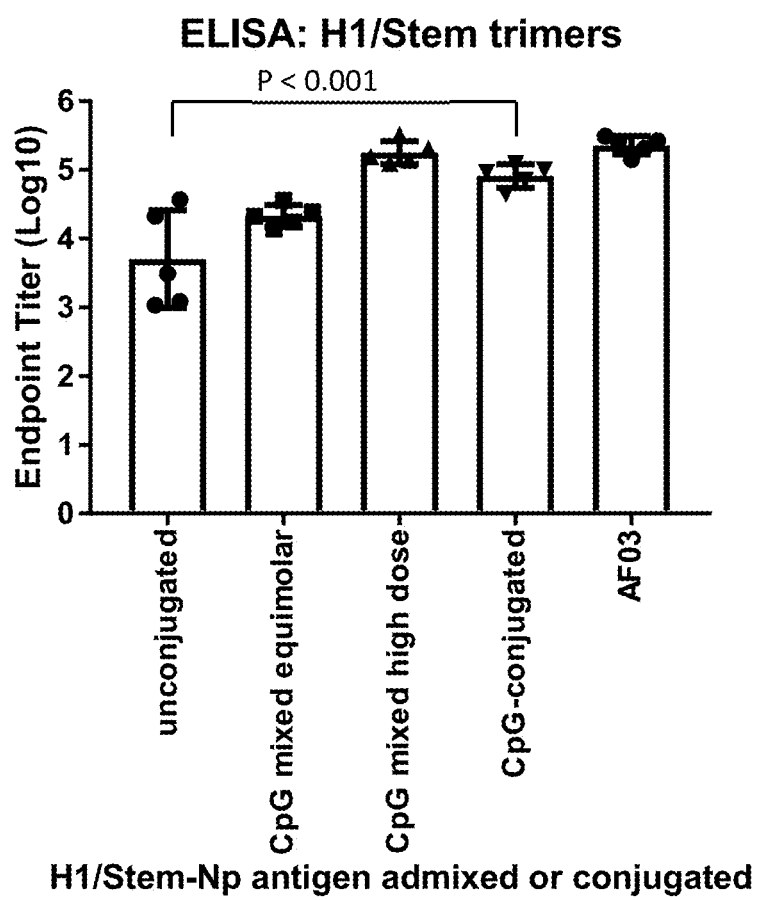
Figure 41A:
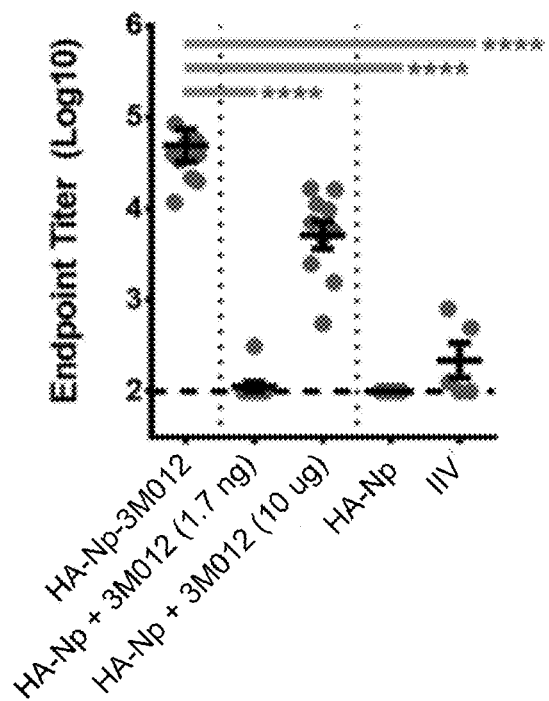
FIGS. 41A-41C. Comparison of titers obtained with NC99 HA-Np with or without conjugated or separate 3M-012 (SEQ ID NO: 309). The antibody response to NC99 HA-Np-3M012 conjugated nanoparticles (0.22 μg/dose) was tested in mice. Admix controls included a mix of HA-Np (0.22 μg/dose) and 10 μg of 3M012 (a typical literature dose) and a mix of HA-Np (0.22 μg/dose) and 1.7 ng of 3M012 (an equimolar match to the conjugate). Additional controls included unconjugated HA-Np and IIV, dosed with matched HA content (0.17 μg HA/dose). Based on ELISA endpoint titers (FIG. 41A), Pseudo-virus (PsV) neutralization IC50 titers, and (FIG. 41B) Hemagglutination Inhibition (HAI) titers (FIG. 41C), the HA-Np-3M012 conjugate induced significantly stronger antibody responses than the equimolar admix control. Conjugated nanoparticles also induced stronger responses (ELISA) and a stronger neutralizing antibody response (PsV) than unconjugated nanoparticles and the IIV standard of care, although this result was not statistically significant in the HAI assay. Assays are of serum from 2 weeks post boost. All samples were run in triplicate. Median+/−SEM is graphed. ** p<0.0001; * p<0.001; **p<0.01; *p<0.05.
Figure 41B:
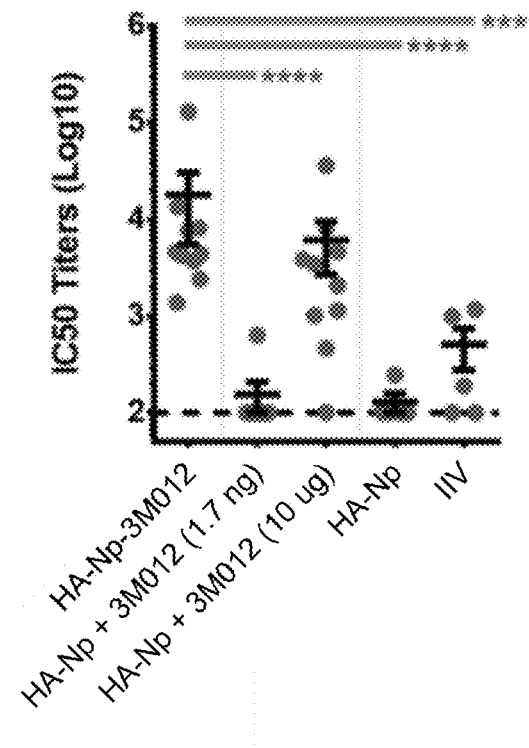
Figure 41C:
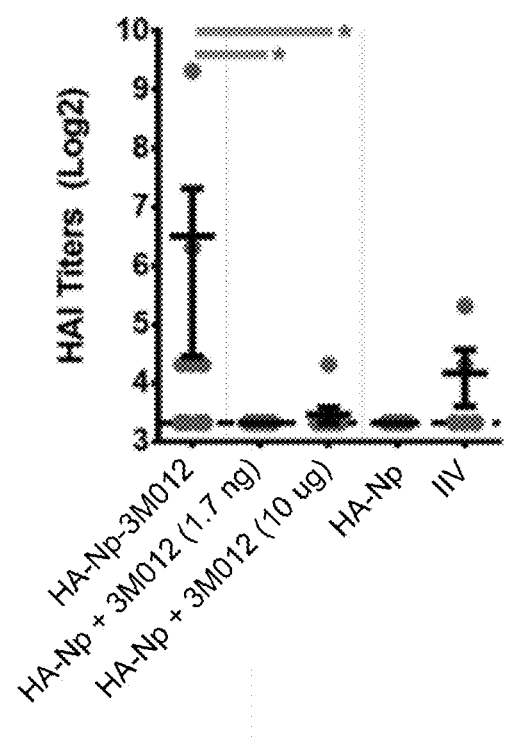
Figure 42A:
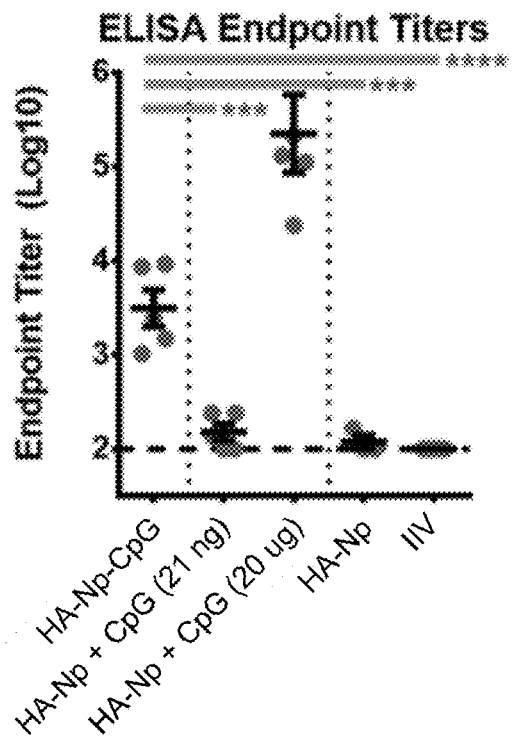
FIGS. 42A-42C. Comparison of titers obtained with NC99 HA-Np with or without conjugated or separate CpG (SEQ ID NO: 309). The antibody response to HA-Np-CpG conjugated nanoparticles (0.22 μg/dose) was tested in mice. Admix controls included a mix of HA-Np (0.22 μg/dose) and 20 μg of CpG (a typical therapeutic dose) and a mix of HA-Np (0.22 μg/dose) and 21 ng of CpG (an equimolar match to the conjugate). Additional controls included unconjugated HA-Np and IIV, dosed with matched HA content (0.17 μg HA/dose). Based on ELISA endpoint titers (FIG. 42A) and Pseudo-virus neutralization IC50 titers (FIG. 42B), the conjugate induced stronger binding and neutralizing antibody responses than the matched admixture, the unconjugated particle, or IIV. The HA-Np-CpG conjugate also induced significantly stronger HAI titers (FIG. 42C) than the equimolar admix control. Additionally, the HAI titers were 2.6- and 3.0-fold higher than unconjugated HA-Ferr and IIV, although these results were not significant. ELISA and PsV assays are of serum from 2 weeks post boost, and HAI assays were performed on serum 5 weeks post boost. All samples were run in triplicate and median+/− SEM are graphed. ** p<0.0001; * p<0.001; **p<0.01; *p<0.05.
Figure 42B:
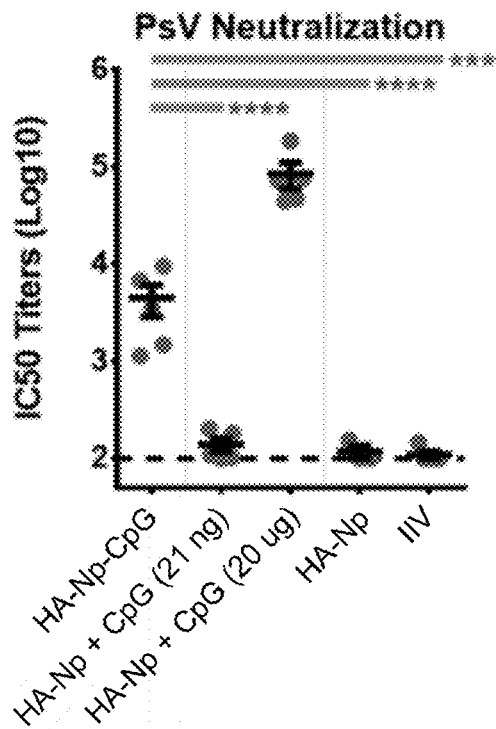
Figure 42C:
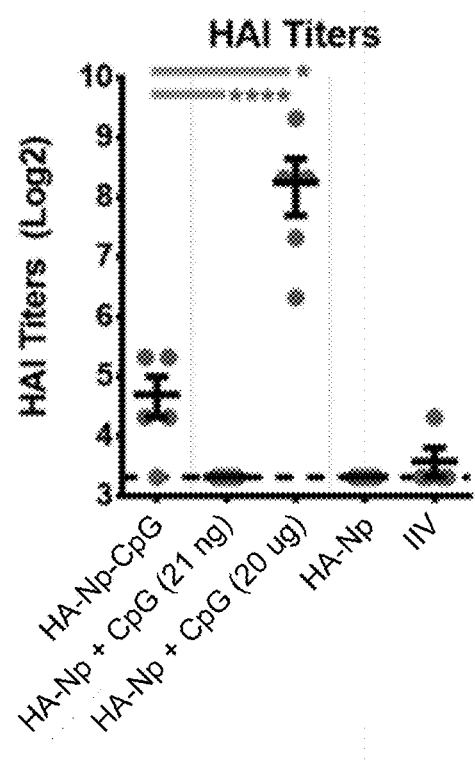

Next, an azide-CpG was added to the H1/Stem-Np-PEG4-DBCO intermediate (labeled "After Mal-PEG4-DBCO" in FIG. 35), which was confirmed by gel-shift assay. Azide-CpG was ordered from IDT (SEQ ID NO: 345). Before SDS-PAGE, conjugates and controls were treated with PNGase. CpG conjugation caused an upward gel-shift due to the added mass (~7.5 kDa) in comparison to linker conjugation. An example of 50% conjugation efficiency quantified by densitometry of the two bands labeled "Stem-Np-CpG" and "Stem-Np" is shown in FIG. 36. Stem-Np is H1/Stem-Np (SEQ ID NO: 343). Untreated refers to H1/Stem-Np before reduction. TCEP-Reduced refers to H1/Stem-Np treated with 3 mM TCEP for 1 hour at room temperature and dialyzed against PBS overnight at 4° Celsius.

A tobacco etch virus (TEV) protease cleavage site (SEQ ID NO: 344) was also used to evaluate conjugation. 3M-012 was conjugated to various NC99 HA-TEV-Np constructs (SEQ ID NOS: 309-312) using a 2-step click chemistry process. HA-TEV-Np constructs were reduced with 2 or 10 mM TCEP. TCEP was removed with dialysis (3 mL dialysis cassette with 10 kDa MWCO, Thermo #87730) into TRIS buffer (100 mM TRIS pH 8.0, 50 mM NaCl). The DBCO-PEG4-Maleimide linker (Sigma #760676) was added. Excess linker was removed with ultrafiltration while also buffer exchanged into PBS 7.4 (100 kDa MWCO, Millipore Amicon #UFC810024 or #UFC910096). Finally, the azide-functionalized TLR agonist (CpG or 3M-012) was clicked onto the molecule. Excess drug was removed by ultrafiltration (100 kDa MWCO, Millipore Amicon #UFC810024 or #UFC910096 or gel filtration. A TEV cleavage site in HA-TEV-Np allows selective cleavage by TEV for analysis of conjugation.

After conjugation to 3M-012 (~500 Da+~600 Da linker) to HA-TEV-Np constructs, the constructs were treated with TEV. Following TEV cleavage, the resulting HA-band on gel-shift SDS-PAGE is about ~57 kDa plus glycans and Ferr ~20 kDa (FIG. 36, lane labelled "+TEV"). The double bands at ~20 and 21 kDa (lanes labelled "S26C," "S72C," "A75C, ", and "S111C" (SEQ ID NOS: 310, 311, 312, and 309, respectively) indicate successful conjugation. The conjugation efficacy corresponds to the band intensity, where the lower band is unconjugated and the upper band is conjugated ferritin.

It was found that H1/Stem-Np comprising S111C has a post-translational modification of 109 Daltons (consistent with cysteinylation) when expressed in 293Expi cells (FIG. 37A), which was removed by reduction with TCEP (tris(2-carboxyethyl)phosphine) at 3 mM concentration for 1 hour at room temperature to free the reactive thiol (FIG. 37B). Thus, the modification can be reduced to expose the surface-exposed cysteine as a free thiol, which is highly reactive towards maleimide groups on commercial linkers or customized small molecules.

MS data also confirmed successful conjugation of 3M-012 to HA-Np. HA-TEV-Np-S26C (SEQ ID NO: 310; FIG. 37C), A75C (SEQ ID NO: 312; FIG. 37D), or S111C (SEQ ID NO: 309; FIG. 37E). Nanoparticles comprising A75C and S111C ferritin modifications (SEQ ID NOS: 312 and 309, respectively) showed greater than 95% conjugation to 3M-012. Thus, the MS data indicates that adjuvants can be linked to various surface exposed cysteines resulting from mutations in ferritins to successfully generate antigenic ferritin polypeptides linked to adjuvants.

Negative stain electron microscopy (EM) confirmed that conjugations did not affect the nanoparticle integrity. Shown are H1/Stem-Np (SEQ ID NO: 343) alone (FIG. 38A), H1/Stem-Np conjugated to maleimide-PEG4-SM7/8a (FIG. 38B), H1/Stem-Np conjugated to CpG (FIG. 38C), NC99 HA-Np (SEQ ID NO: 309) alone (FIG. 38D), NC99 HA-Np conjugated to 3M-012 via the DBCO-maleimide linker (FIG. 38E), and NC99 HA-Np conjugated to CpG via the DBCO-maleimide linker (FIG. 38F). Further, conjugation of a TLR7/8 agonist (maleimide-PEG4-SM7/8a, FIG. 38A) or TLR9 agonist (CpG, FIG. 38B) via maleimide-PEG4-DBCO linker to H1/Stem-Np does not affect nanoparticle integrity as measured by dynamic light scattering (DLS) compared to unconjugated H1/Stem-Np (FIG. 39C).

These data demonstrate the successful preparation of antigenic polypeptides comprising ferritin and HA polypeptides. Further, linkers comprising adjuvant can be successfully conjugated to these ferritin nanoparticles.

Example 9: Characterization of Immunogenicity of HA-Ferritin Nanoparticle Compositions The effect of various adjuvants and of conjugating TLR agonists to H1/Stem-Np on the immunogenicity of H1/Stem-Np compositions was assessed. FIG. 40A shows IgG antibody titers to H1/New Caledonia/1999 (NC99) HA trimers induced by immunization with H1/Stem-Np TLR7/8-agonist conjugate. Dosing was at week 0 and week 3 with 10 μg of H1/Stem-Np, administered without adjuvant, with admixed equimolar amount of free SM7/8a adjuvant (83.3 ng), with admixed high dose free SM7/8a adjuvant (21.84 μg), or with a 1:1 volume ratio of either PAA or AF03 adjuvant. The H1/Stem-Np-SM7/8a conjugate was administered in the absence of any other adjuvants. Sera were assayed 2 weeks after a second dose. FIG. 40B shows IgG antibody titers to H1/Stem trimers induced by immunization with H1/Stem-Np TLR9-agonist conjugate. Dosing was at week 0 and week 3 with 10 μg of H1/Stem-Np, administered without adjuvant, with admixed equimolar amount of free CpG adjuvant (850 ng), with admixed high dose free CpG adjuvant (20 μg), or with a 1:1 volume ratio of AF03 adjuvant. The H1/Stem-Np-CpG conjugate was administered in the absence of any other adjuvants. Sera were assayed 2 weeks after a second dose.

Data in FIG. 40A indicated that an SM7/8a-conjugated H1/Stem-Np showed comparable immunogenicity as an unconjugated nanoparticle admixed with a polyacrylic acid (PAA) or AF03 adjuvant. The SM7/8a conjugated directly to the ferritin nanoparticles was more effective that an equimolar dose of SM7/8a administered as a separate compound from the ferritin nanoparticle ("mixed equimolar"). Further, the SM7/8 conjugated directly to the ferritin nanoparticles was more effective than a higher dose of SM7/8a administered as a separate compound from the ferritin nanoparticle ("mixed high"). Thus, conjugation of SM7/8a to the antigenic polypeptide comprising an HA polypeptide and ferritin rendered the compound immunogenic and self-adjuvanting. Administration of a self-adjuvanting composition could allow reduction or elimination of a separate adjuvant. Similarly, FIG. 40B indicated that conjugation of the TLR9- agonist CpG to H1/Stem-Np improves its immunogenicity compared to unconjugated and equimolar admixed controls to levels that are comparable to administering a 23× higher dose of admixed CpG molecule.

Sera were also assessed for the ability to neutralize H1/New Caledonia/1999 (NC99) HA/NA pseudotyped lentivirus in vitro. The pseudotyped neutralization assay was performed as previously described (Kanekiyo et al., Nature 499:102-106 (2013)). Briefly, lentiviruses were packaged in HEK293T cells by transfection of 5 plasmids, 400 ng of HA, 100 ng of NA, 50 ng of TMPRSS2, 7 μg of CMVAR8.2 and 7 μg of pHR'CMV-Luc with the Profection Mammalian Transfection kit (Promega catalog #E1200). Viral particles were collected 48 and 72 hours post-transfection and filtered through a 0.45 μm filter.

Mice (n=5/group) were immunized twice at a three-week interval. NC99 HA-Np (SEQ ID NO: 309) conjugated to 3M-012 (HA-Ferr-3M-012, 0.22 μg/dose) was administered in parallel with admixed controls: a mix of NC99 HA-Np (0.22 μg/dose) and 10 μg of 3M-012 (a typical therapeutic dose), and separately, a mix of NC99 HA-Np (0.22 μg/dose) and 1.7 ng of 3M-012 (an equimolar match to the conjugate). Additional controls were unconjugated NC99 HA-Np and an inactivated influenza vaccine (IIV), dosed with matched HA content (0.17 μg HA/dose). At week 5, serial dilutions of the serum from these mice were assayed for neutralization activity towards lentiviruses pseudotyped with HA and neuraminidase (NA) genes from the strains indicated. Antisera at a range of dilutions were pre-incubated with a fixed amount of lentivirus and used to infect target 293A cells. Infection was quantified 72 hours later with the Promega Luciferase Assay System (catalog #E1500). The $IC_{50}$ values were calculated with Graphpad Prism software from these neutralization curves, to determine the serum dilution factor that attains 50% neutralization of PsV. Endpoint titers (ELISA) and Hemagglutination Inhibition (HAI) titers were also determined at weeks 5 and 8, respectively. See the following example for exemplary ELISA and HAI procedures. All samples were run in triplicate.

Based on the ELISA endpoint titers (FIG. 41A) or pseudovirus neutralization $IC_{50}$ titers (FIG. 41B), NC99 HA-Np conjugated to 3M-012 induced stronger binding and neutralizing antibody responses than the matched admixture, the unconjugated particle, or IIV. The HA-Np-3M-012 conjugate also induced significantly stronger HAI titers (FIG. 41C) than the equimolar admix control. Additionally, the HAI titers were 3.7- and 1.6-fold higher than unconjugated HA-Ferr and IIV, although these results were not significant.

The immunogenicity of H1/Stem-Np-TLR agonist conjugates was also assessed in a non-human primate model. Twelve cynomolgus macaques (*Macaca fascicularis*) were housed and cared for by Bioqual Inc. in compliance with all federal regulations, including USDA regulations and the Animal Welfare Act. Animals were pre-screened and selected for lack of reactivity to 2016-2017 Fluzone Quadrivalent antigens (A/California/07/2009; A/HongKong/4801/2014 X-263B; B/Phuket/3073/2013; B/Brisbane/60/2008) by ELISA. NHP subjects (10 females, 2 males), 5 to 13 years old, and 3.5 kg to 7.8 kg in weight, were randomly-assigned to each immunization group (n=3 animals/group). Each received three doses, at weeks 0, 4 and 10 of either 50 μg of H1-SS-np with AF03, or 200 μg of H1-SS-np (no adjuvant control), or 200 μg of H1-SS-np-SM7/8 conjugate, or 200 μg of H1-SS-np-CpG. Blood samples of 10 mLs were collected for serum isolation at weeks 0, 2, 4, 6, 8, 10 and 12. Blood samples of 10-16 mLs were collected at weeks 0, 2, 5, 6 and 12 for PBMC isolation. Serum and PBMCs were isolated and cryopreserved following standard operating procedures. Cynomolgus macaques were assigned with to be immunized at weeks 0, 4 and 10 with either 50 μg of H1/Stem-Np formulated with admixed AF03 adjuvant, or 200 μg H1/Stem-Np (no adjuvant control), or 200 μg of H1/Stem-Np-SM7/8a conjugate (shown in FIG. 28A) or 200 μg of H1/Stem-Np-CpG conjugate (shown in FIG. 28B). Serum, isolated at various timepoints, were assayed for anti-HA antibody titers by ELISA (FIG. 50A), and for neutralization of lentivirus pseudotyped with H1-subtype HA and NA (FIG. 50B) or with H5-subtype HA and NA (FIG. 25C). Taken together, the results shown in FIGS. 50A-C demonstrate that conjugation of TLR-agonists improves the immunogenicity of H1/Stem-Np in a non-human primate model. In this model, the TLR7/8 agonist conjugate appears to give higher titers than the CpG conjugate and the AF03 admixed adjuvant elicited the highest titers at the conditions tested.

The immunogenicity of NC99 HA-Np (SEQ ID NO: 309) conjugated to CpG (HA-Ferr-CpG, 0.22 μg/dose) was also assessed in comparison with admixed controls (a mix of HA-Np (0.22 μg/dose) and 20 μg of CpG (a typical therapeutic dose) and a mix of HA-ferr (0.22 μg/dose) and 21 ng of CpG (an equimolar match to the conjugate)). Additional controls were unconjugated HA-Np and IIV, dosed with match HA content (0.17 μg HA/dose). Dosing was at weeks 0 and 3 as described above. ELISA and PsV assays are of serum from 2-weeks post-boost, and HAI was performed on serum 5-weeks post-boost. All samples were run in triplicate.

Based on ELISA endpoint titers (FIG. 42A) or pseudovirus neutralization IC50 titers (FIG. 42B), the conjugate induces stronger binding and neutralizing antibody responses than the matched admixture, the unconjugated particle, or IIV. The HA-Np-CpG conjugate induces significantly stronger HAI titers (FIG. 42C) than the equimolar admix control. Additionally, the HAI titers were 2.6- and 3.0-fold higher than unconjugated HA-Ferr and IIV, although these results were not significant.

Next, it was determined if the immunogenicity of the 3M012 conjugate could be improved when given at a higher dose. To do this, the conjugate, an equimolar admixture, a higher dose admixture, and unconjugated nanoparticles were tested at 0.1 μg, 0.5 μg, 2.5 μg, and 12.5 μg doses of HA-NP (FIGS. 51A-B). At the 0.1 μg and 0.5 μg HA-NP dose, minimal response was seen in neutralization and HAI assays except for the high admixture dose. At the 2.5 μg dose, the unconjugated HA-NP and the equimolar admixture of HA-NP and 3M012 both induced minimum antibody responses. Compared to the high dose admixture group, the 3M012-conjugated HA-NP induced similar antibody responses despite containing >5000-fold less 3M012, documenting the efficacy of direct conjugation and targeted delivery of a TLR agonist.

Example 10: Characterization of Nanoparticles Comprising Candidate Polypeptides by EM and DLS HA-Nps comprising the flu polypeptides presented in FIG. 26A were expressed and released into the culture media (sequence alignment of HA portions shown in FIG. 26A and dendogram shown in FIG. 26B) using the processes outlined above. The arrows in FIG. 26B indicate candidate polypeptides. HA-Nps listed in FIG. 43A were purified from 293Expi cell culture supernatant by anion exchange and size exclusion chromatography. Coomassie staining results confirming successful product of nanoparticles are shown in FIG. 43B.

Electron microscopy (EM) and dynamic light scattering (DLS) analyses were performed as follows.

Figure 43C:
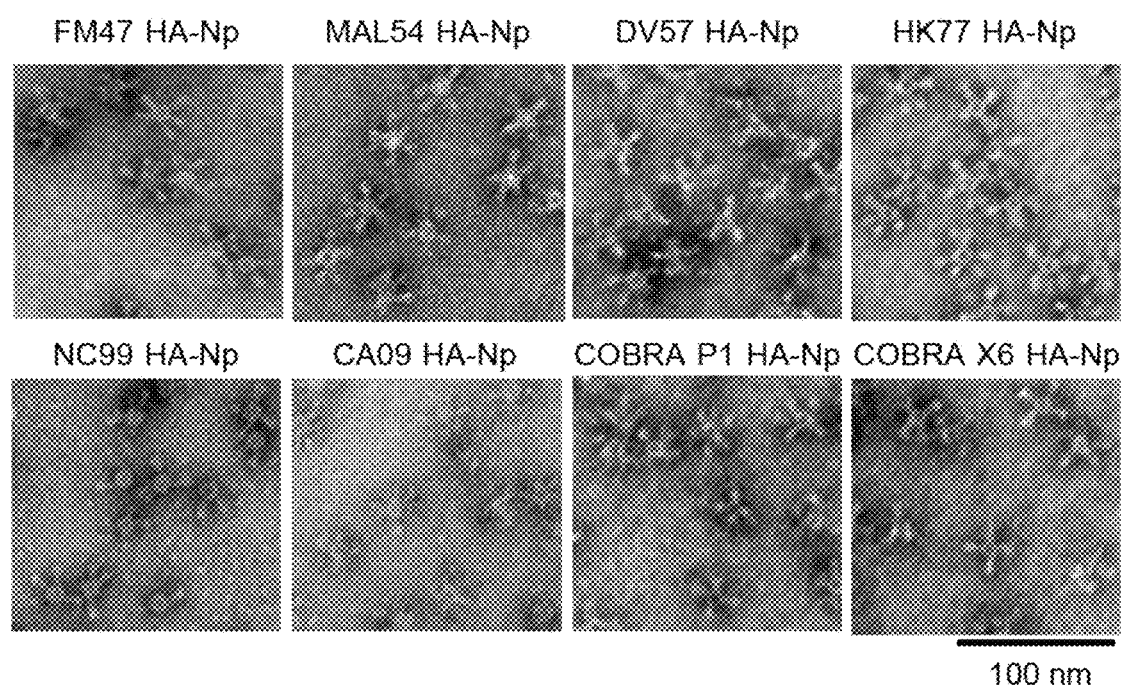

Dynamic Light Scattering was measured on Wyatt's DynaPro Plate Reader II at 25° C. The purified HA-Nps displayed the expected size by dynamic light scattering, between 16 and 18 nanometers (FIG. 43A, indicated by the "size" measure). The formation of nanoparticles was also confirmed by negative stain transmission electron microscopy (TEM) (FIG. 43C). For EM, HA-ferritin nanoparticle samples were adsorbed for 1 minute to a carbon coated grid that had been made hydrophilic by a 30 second exposure to a glow discharge. Excess liquid was removed with a filter paper (Whatman #1) and the samples were stained with 0.75% uranyl formate for 30 seconds. After removing the excess uranyl formate with a filter paper the grids were examined in a TecnaiG$^2$ Spirit BioTWIN and images were recorded with an AMT 2 k CCD camera.

Example 11: Immunogenicity of Single Strain HA-Ferritin Nanoparticles Against a Representative Panel of Divergent H1N1 Influenza Viruses To study the immunogenicity of HA-Nps from specific viral strains, mice were immunized twice with the nanoparticle from the strain of interest, and sera were assayed 3 weeks after the second immunization using hemagglutinin inhibition assay (HAI). All immunizations followed established guidelines for animal handling. Balb/C mice (5/group) were immunized at weeks 0 and 3 with 220 ng of HA-ferritin nanoparticles (170 ng of HA content), and where applicable mixed 1:1 with adjuvant immediately before intramuscular injection (50 μL per hind leg). Ribi (Sigma Adjuvant System, catalog #56322-1vl) or AF03 (Sanofi Pasteur) were used as indicated in the figure legends. For bivalent, trivalent, and quadrivalent combinations, 220 ng of each nanoparticle was pre-mixed before injection. Sera were collected at 2 and 3 weeks post-boost injection.

HA inhibition assays (HAI) used influenza seed stocks were from the Centers for Disease Control and Prevention (Atlanta, GA, USA). The immune sera were pre-treated with receptor-destroying-enzyme (RDE) by diluting one-part serum with three-parts enzyme and incubated overnight in a 37° C. water bath. The enzyme was inactivated by 30-minute incubation at 56° C. followed by addition of six parts PBS to a final dilution of 1/10. HAI assays were performed in V-bottom 96-well microtiter plates with 4 HA units of virus (HAU) in 0.5% turkey red blood cells. The HAI titer was determined as the highest dilution of serum resulting in complete inhibition of hemagglutination.

For all data, error bars represent the standard error of the mean obtained from assaying samples from each animal in a given treatment group; n=5 for mice, and n=12 for ferrets. Student's T test was calculated with Microsoft Excel. ANOVA was calculated with VassarStats (available via web at vas sarstats.net/anova1u.html).

A panel of 16 representative influenza strains was used spanning 78 years of viral evolution. Viruses in the panel are listed in Table 2.

TABLE 2

Panel of H1N1 Influenza strains used for HAI
H1N1 HAI Influenza Panel

A/Puerto Rico/1934
A/Weiss/1/1943
A/FM/1/1947
A/Denver/1/1957
A/New Jersey/8/1976
A/USSR/90/1977
A/Brazil/11/1978
A/Chile/1/1983
A/Taiwan/1/1986
A/Texas/36/1991
A/Beijing/262/1995
A/New Caledonia/20/1999
A/Solomon Islands/6/2006
A/Brisbane/59/2007
A/California/07/2009
A/Bangladesh/2021/2012
A/Vietnam/3050/2013

Potent neutralization of the matched strain was observed in all cases (CA09, NC99, FM47, and HK77, FIGS. 44A-44D).

Serological responses were also confirmed by ELISA against matched antigens (FIGS. 45A-45F). Immunogens administered to each group are listed in FIG. 45A. Trimers were used for ELISAs, as indicated by FIGS. 45B-45F.

For the ELISA assay, Nunc MaxiSorp 96-well plates (catalog #44-2404-21) were coated with 100 ng/well of trimeric HA or stabilized stem proteins overnight at 4° C. and blocked with 5% skim milk in PBST. Anti-sera were diluted as indicated and incubated for 1 hour at room temperature, and bound antibodies were detected with an anti-mouse-HRP antibody (catalog #NA931 at 1:5,000) or anti-monkey-HRP antibody (Southern Biotech catalog #4700-05, Lot #A3814-P907, at 1:5,000) in 5% milk-PBST, also incubated for 1 hour at room temperature. After washing with PBST 5 times, HRP was developed with SureBlueTMB substrate (Catalog #52-00-02) and stopped with 0.5 N sulfuric acid. Absorbance was read at 450 nm (Spectramax M5). Endpoint titers were calculated with Graphpad prism with a threshold value of 0.2 and the typical background level is 0.05.

Neutralization of HA/NA pseudotyped lentiviruses was also evaluated as described above and results are shown in Table 3. Strong neutralization activity was observed for the matched strains in all cases tested, and these values were used as thresholds. The combination of HA-Nps with complementary neutralization activities led to expanded cross-reactivity in an additive manner.

TABLE 3

Neutralization IC50 towards HA/NA pseudotyped lentiviruses (PsV) in mice after two immunizations with HA-ferritin nanoparticles administered as single components or in combination

| Group # | Immunogens | FM 1947 | Malaysia 1954 | Hong Kong 1977 | New Caledonia 1999 |
|---|---|---|---|---|---|
| 1 | NC99 Np | <200 | <200 | $1.8 \times 10^3$ | $5.8 \times 10^4$ |
| 2 | CA09 Np | <200 | <200 | $8.8 \times 10^2$ | $5.3 \times 10^2$ |
| 3 | FM47 Np | *$4.2 \times 10^5$* | $2.1 \times 10^4$ | $2.8 \times 10^4$ | $4.8 \times 10^2$ |
| 4 | HK77 Np | *$1.2 \times 10^5$* | $1.7 \times 10^4$ | *$4.6 \times 10^5$* | $9.9 \times 10^2$ |
| 5 | Mal54 Np | $4.3 \times 10^3$ | *$5.7 \times 10^5$* | $6.8 \times 10^3$ | $2.8 \times 10^3$ |
| 6 | NC99 + CA09 Np | <200 | <200 | $2.1 \times 10^3$ | $6.2 \times 10^4$ |

TABLE 3-continued

Neutralization IC50 towards HA/NA pseudotyped lentiviruses (PsV) in mice after two immunizations with HA-ferritin nanoparticles administered as single components or in combination

| Group # | Immunogens | FM 1947 | Malaysia 1954 | Hong Kong 1977 | New Caledonia 1999 |
|---|---|---|---|---|---|
| 7 | NC99 + CA09 + FM47 Np | *4.4 × 10⁵* | 1.6 × 10³ | 2.3 × 10⁴ | *2.9 × 10⁵* |
| 8 | NC99 + CA09 + HK77 Np | *2.8 × 10⁵* | 8.9 × 10³ | *2.1 × 10⁵* | *1.5 × 10⁵* |
| 9 | NC99 + CA09 + Mal54 Np | 1.7 × 10³ | *1.6 × 10⁵* | 2.2 × 10³ | *1.7 × 10⁵* |
| 10 | NC99 + CA09 + HK77 + FM47 Np | *4.1 × 10⁵* | 2.6 × 10³ | *2.1 × 10⁵* | *1.4 × 10⁵* |
| 11 | NC99 + CA09 + HK77 + MAL54 Np | 7.4 × 10⁴ | *1.5 × 10⁵* | *1.6 × 10⁵* | *2.7 × 10⁵* |
| 12 | NC99 + CA09 + FM47 + MAL54 Np | *3.7 × 10⁵* | *1.1 × 10⁵* | 3.1 × 10⁴ | 9.8 × 10⁴ |
| 13 | NC99 IIV | 1.0 × 10³ | <200 | 1.6 × 10³ | 4.8 × 10⁴ |
| 14 | CA09 IIV | <200 | <200 | 1.6 × 10³ | 1.0 × 10³ |
| 15 | NC99 + CA09 IIV | 1.0 × 10³ | <200 | 1.7 × 10³ | 3.0 × 10⁴ |

<10,000 Regular font
>10,000 Bold font
>100,000 Italic font

Figure 44A:
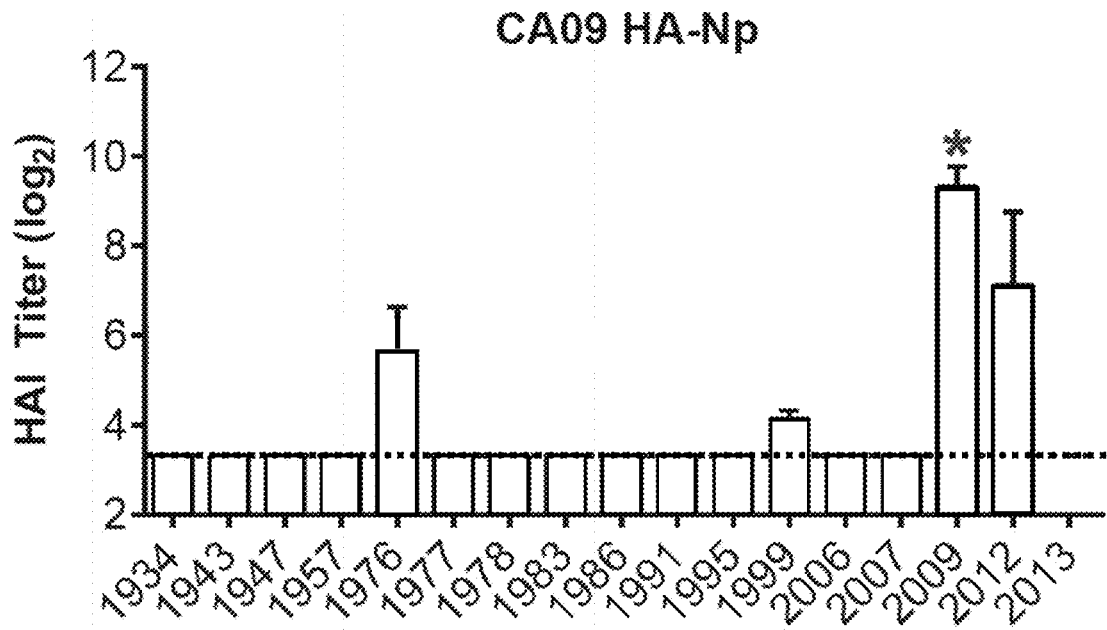
FIGS. 44A-44H. Potency and breadth of immune response elicited by various HA-ferritin nanoparticles (see legend for FIGS. 26A-B for SEQ ID NOs.). Hemagglutination Inhibition (HAI) titers ($\log_2$) of sera from mice 6 weeks after immunization with the indicated HA-Np vaccine were assayed against a panel of divergent H1N1 influenza viruses. Mice (n=5) were immunized with hemagglutinin nanoparticles (HA-Nps) at weeks 0 and 3. Dashed line indicates the assay limit of detection.
Figure 44B:
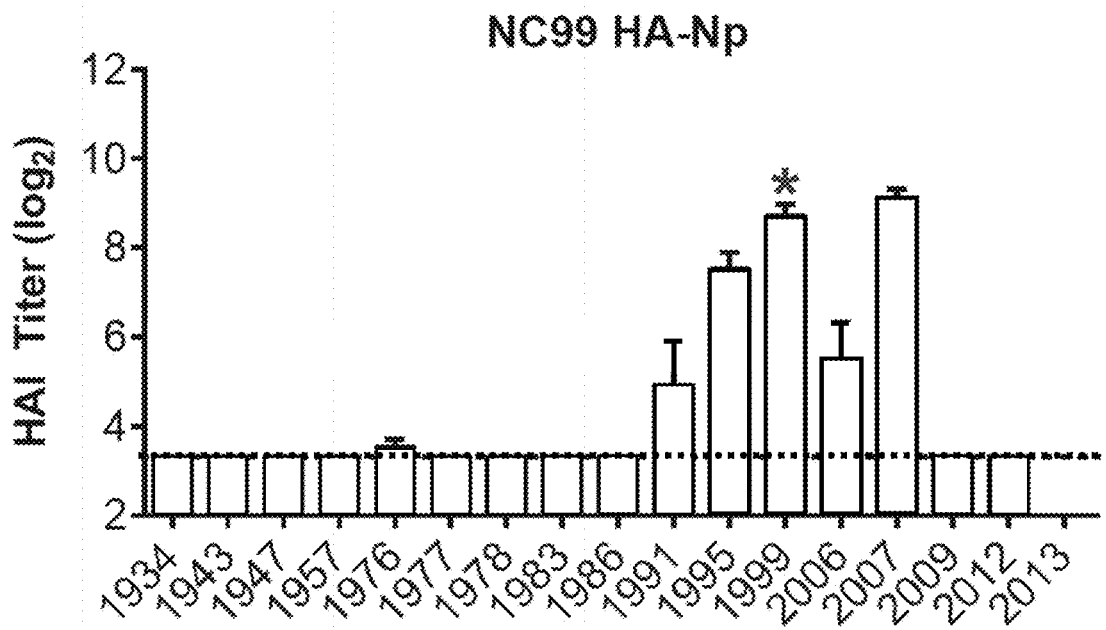
Figure 44C:
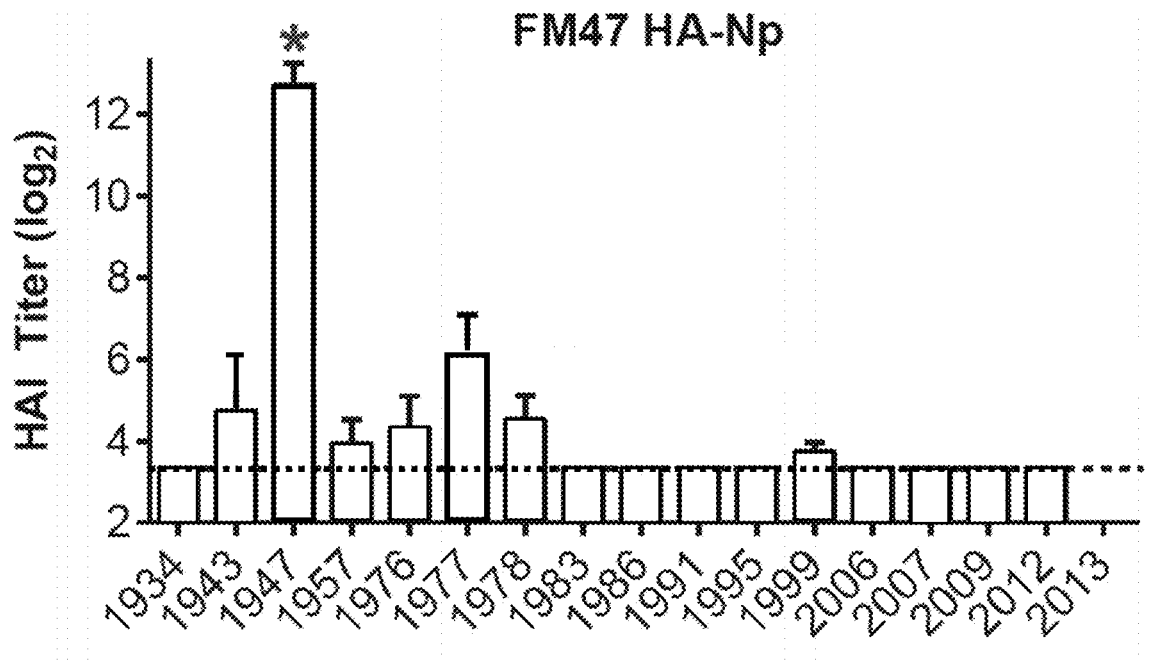
Figure 44D:
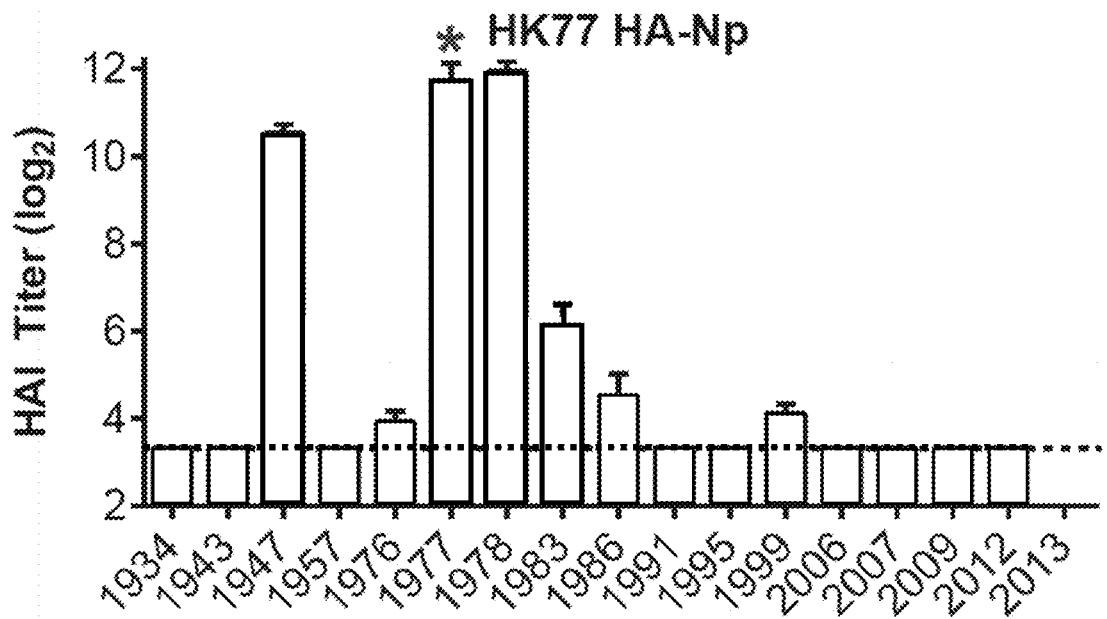
Figure 44E:
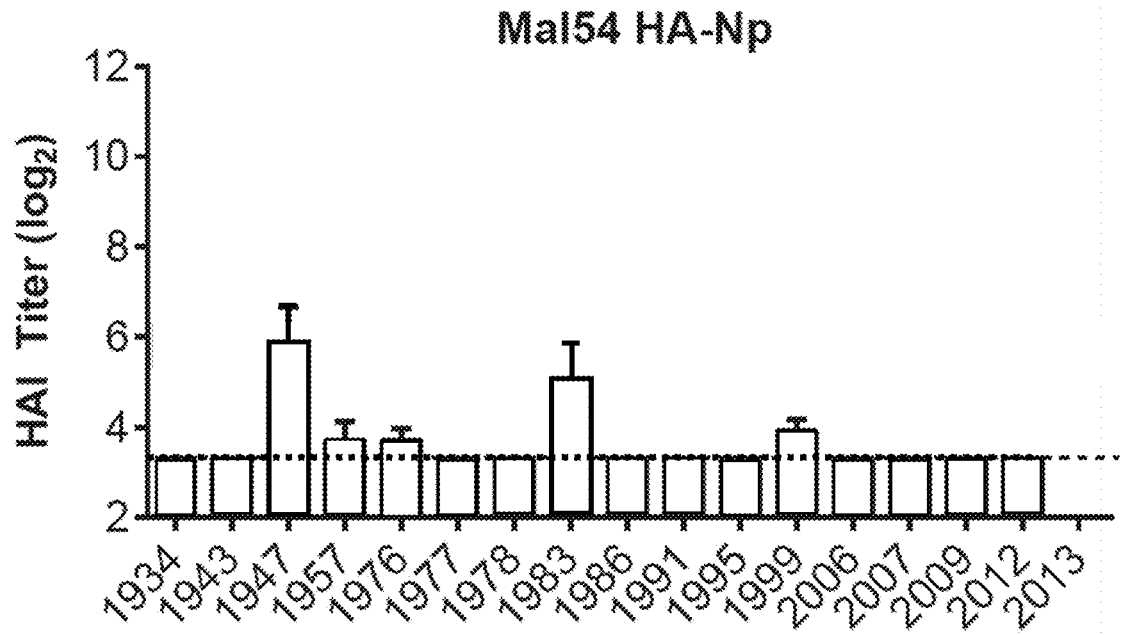
Figure 44F:
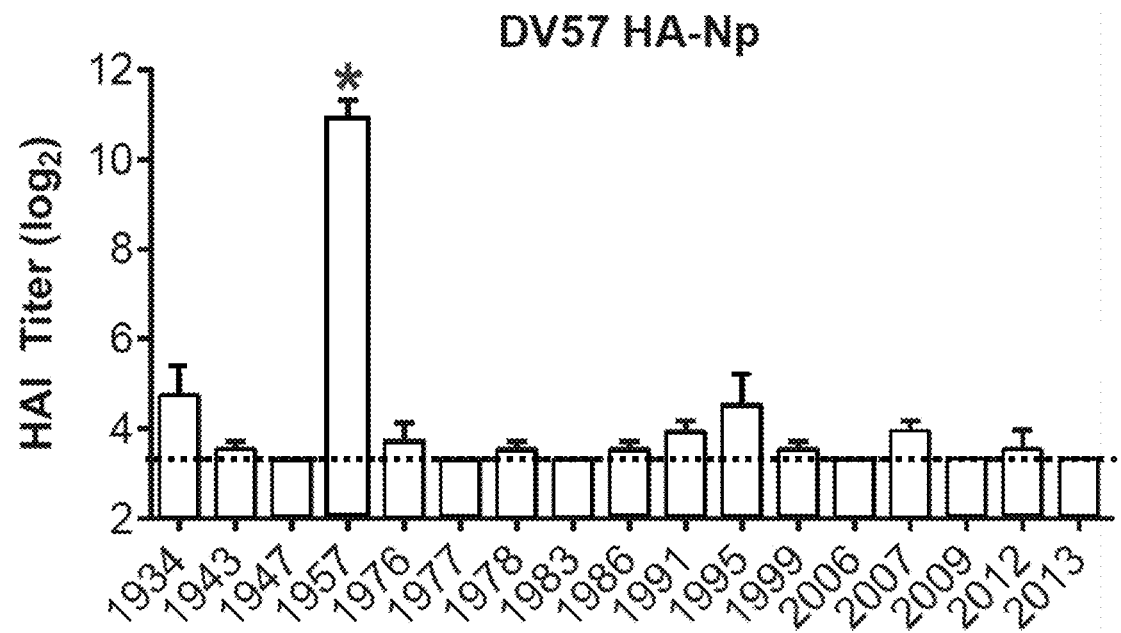

The CA09 HA-Np elicited strong immune responses, but these were limited to contemporary (post-2009) strains and a 1976 isolate that also originated from swine and has close homology to CA09 (FIG. 44A) (see Gaydos et al. 2006. Emerg Infect Dis 12:23-28 (1976)). NC99 HA-Np elicited potent neutralization against influenza viruses from the late 1990s and early 2000s (FIG. 44B). The immunological response to FM47 HA-Np extended primarily to the matched strain, but it also showed modest cross-reactivity to the 1977 strain (FIG. 44C). This level of cross-reactivity has clinical relevance to the 1977 outbreak, which affected primarily people under 26 years of age, suggesting that exposure to influenza viruses from 1940-50 outbreaks conferred protection against the 1977 strains (Kilbourne 2006). Interestingly, among the HA sequences, the HK77 HA-Np stood out because its cross-reactivity extended to strains from 1947, 1978 and 1983 (FIG. 44D). On the other hand, the immunological responses to MAL54 HA-Np and DV57 HA-Np were restricted to the matched strain (FIG. 44E, 44F, and Table 3).

Figure 44G:
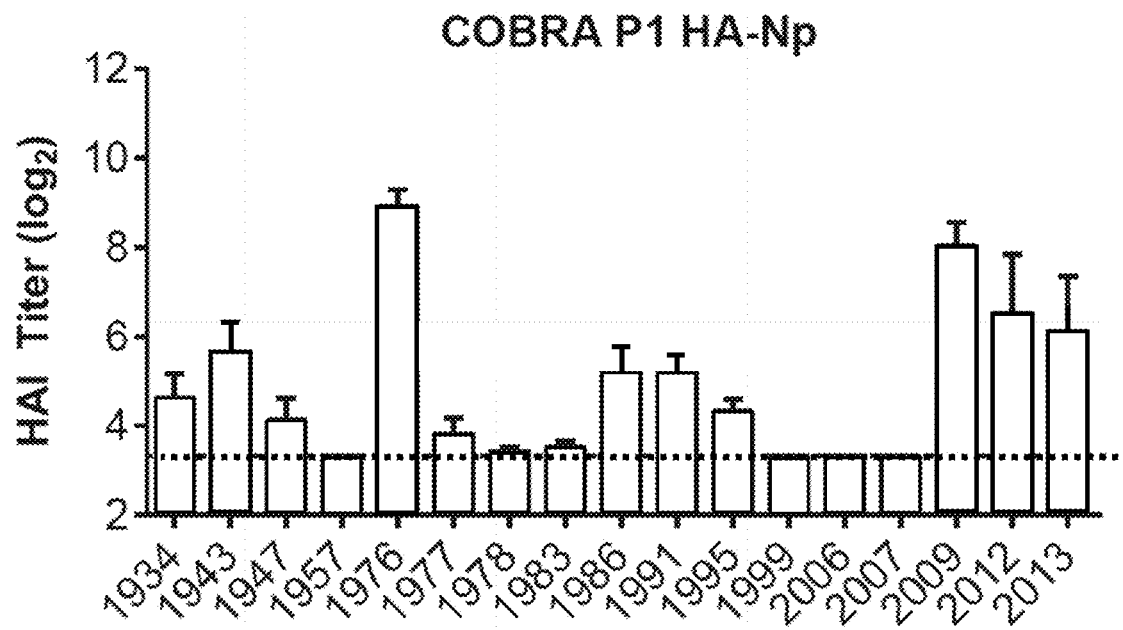
Figure 44H:
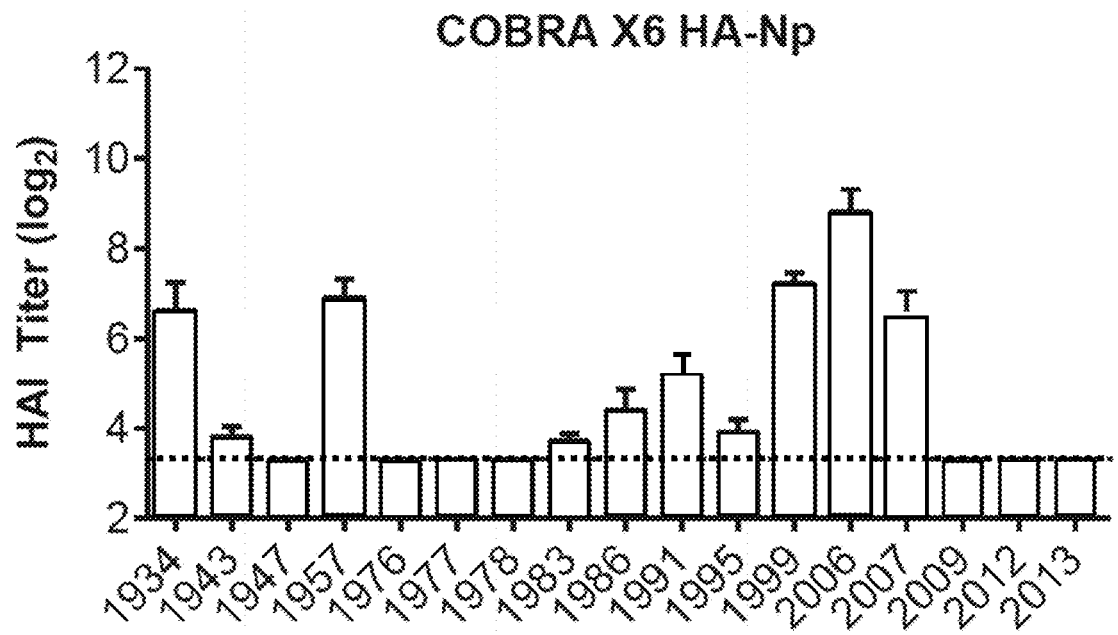
Figures 45A, 45B:
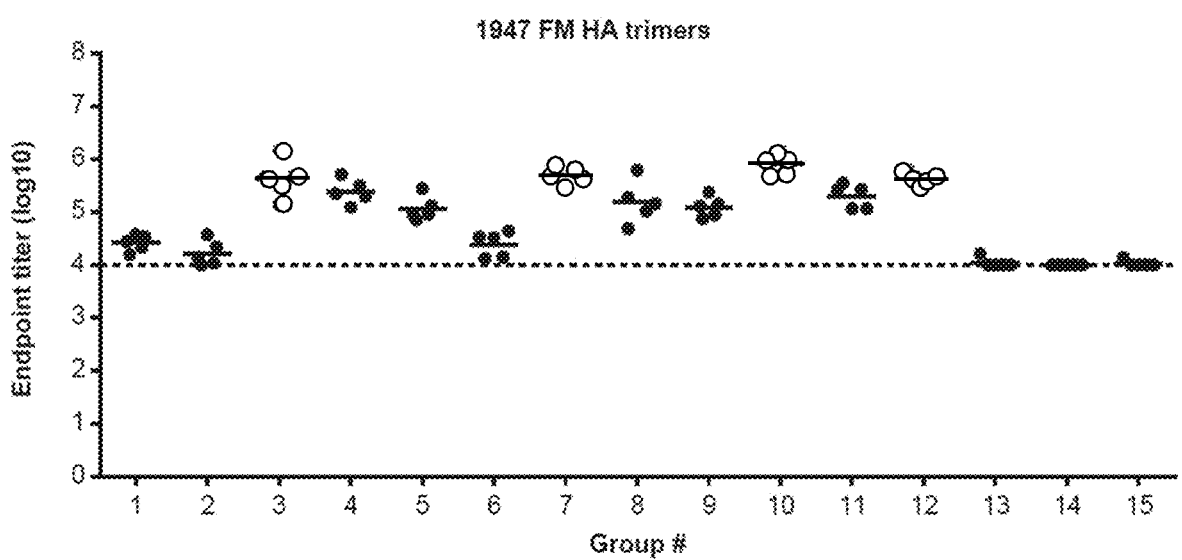
FIGS. 45A-45F. HA antibody responses induced by HA-ferritin nanoparticles.
Figure 45C:
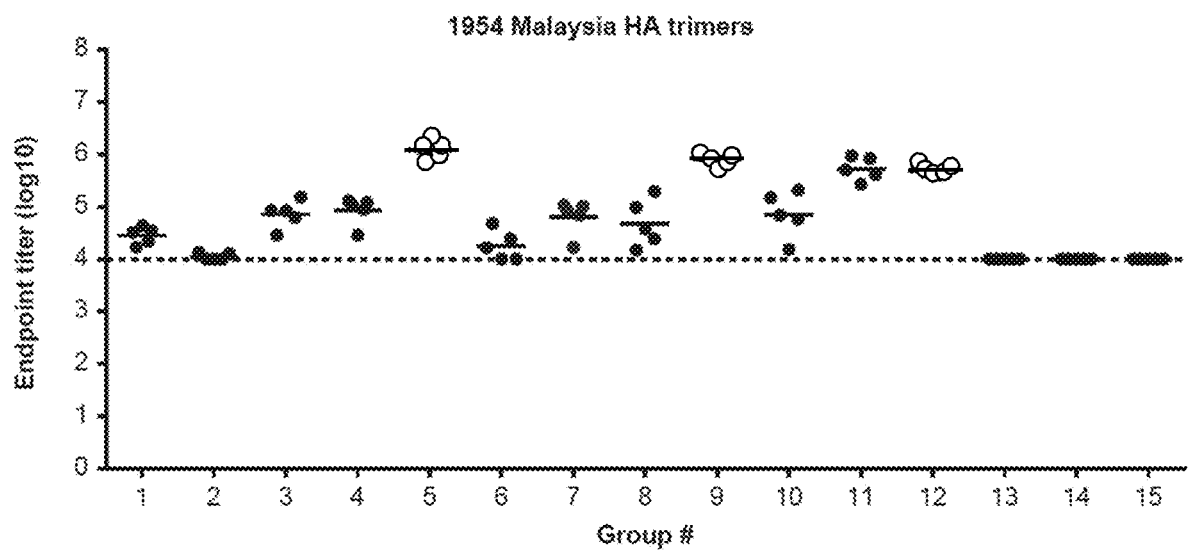
Figure 45D:
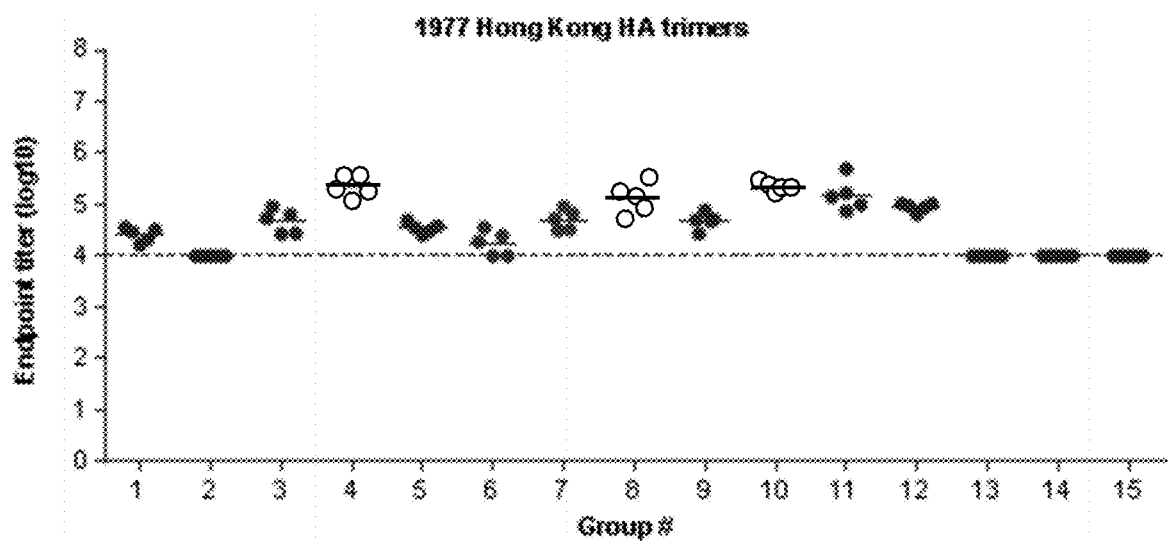
Figure 45E:
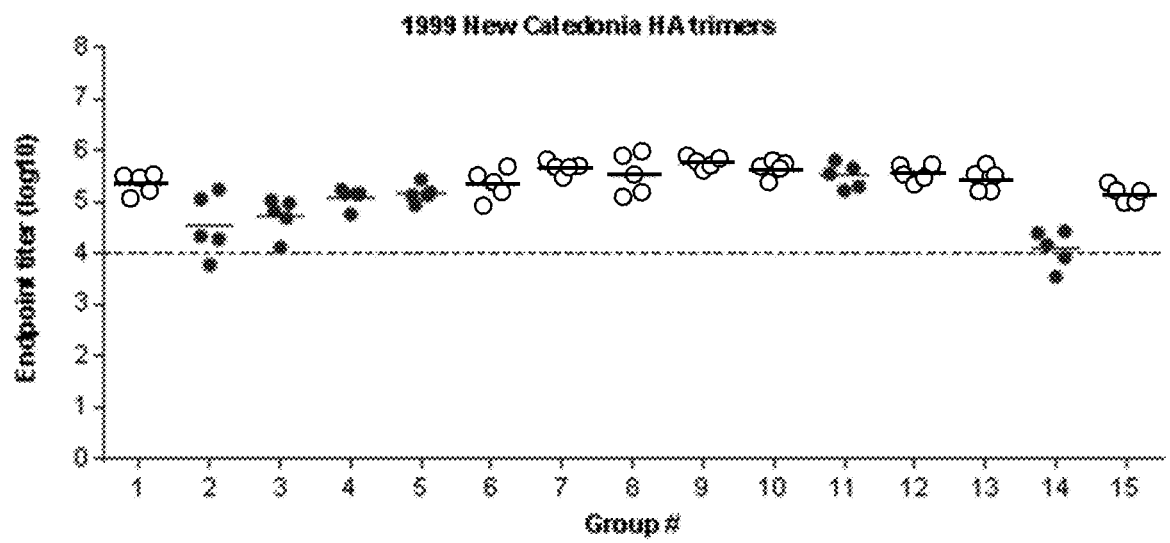
Figure 45F:
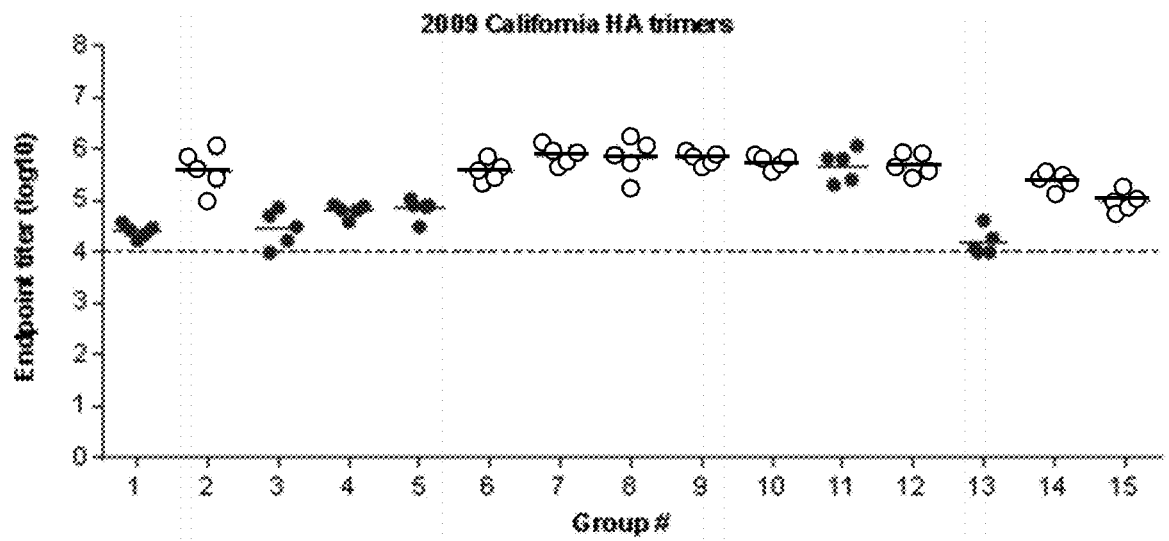

The cross-reactivity observed with COBRA P1 and COBRA X6 nanoparticles were consistent with their virus-like particle (VLP) counterparts (see, Carter D M, et al., J Virol 90:4720-4734 (2016)). The immune response elicited by COBRA P1 HA-Np was similar to CA09 HA-Np (FIGS. 44A and 44G) and COBRA X6 HA-Np showed a similar immune profile to NC99 HA-Np (FIGS. 44B and 44H).

Figure 46A:
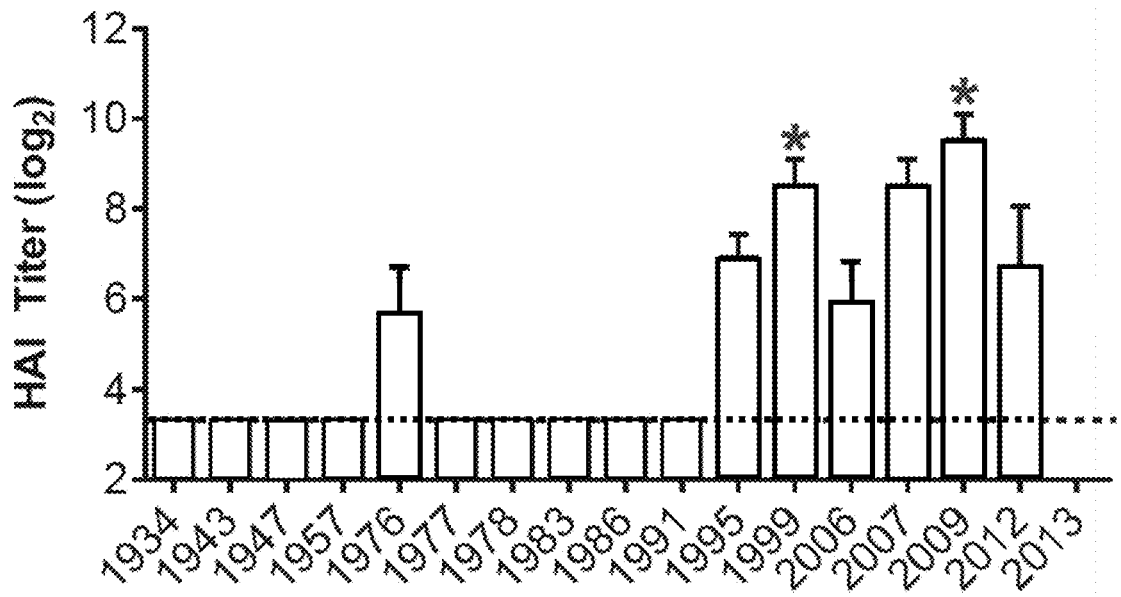
FIGS. 46A-46H. Antibody response to HA-mixtures of multiple ferritin nanoparticles administered to mice as measured by assays of HAI titers.
Figure 46B:
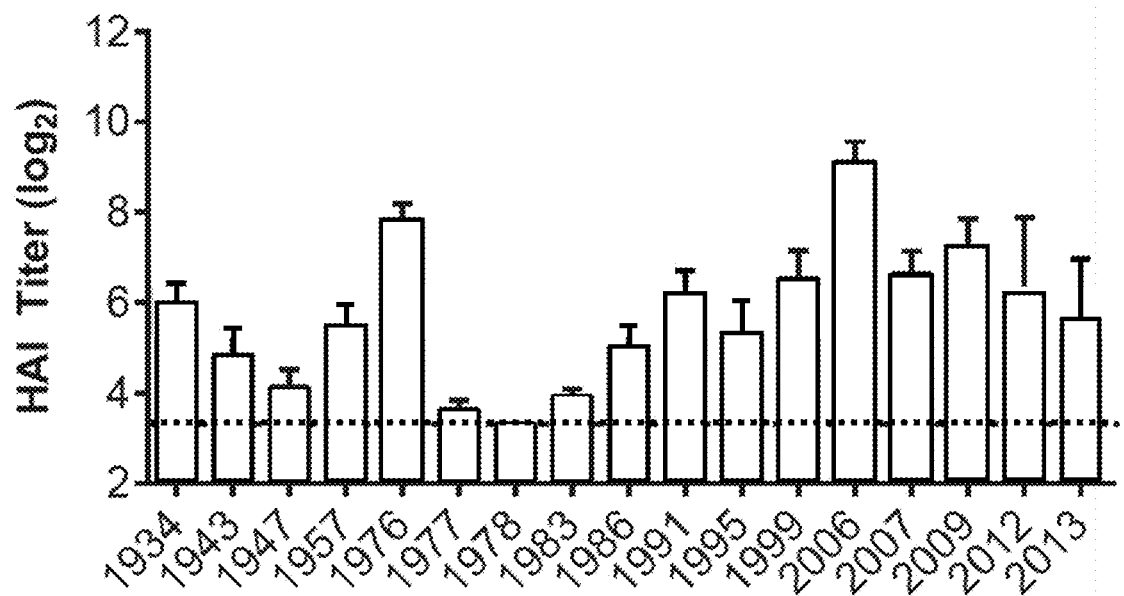
Figure 46C:
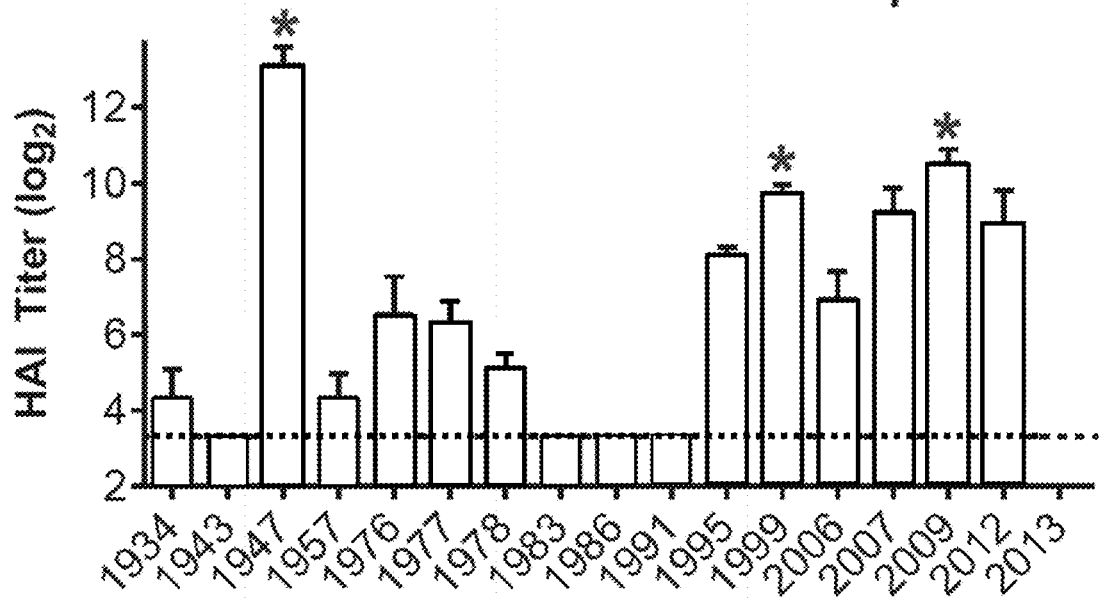
Figure 46D:
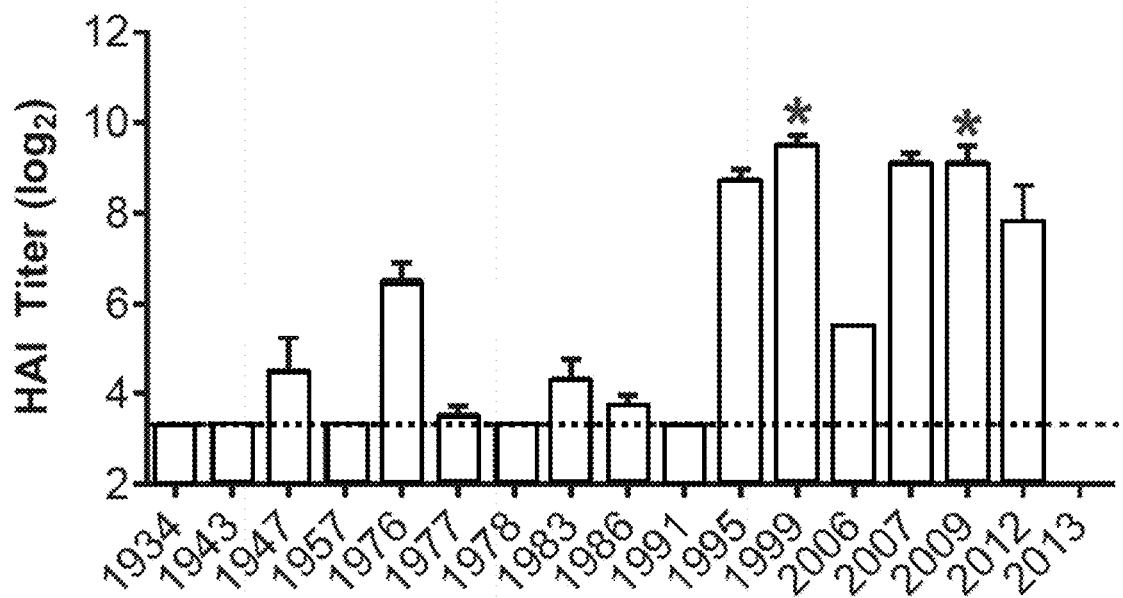
Figure 46E:
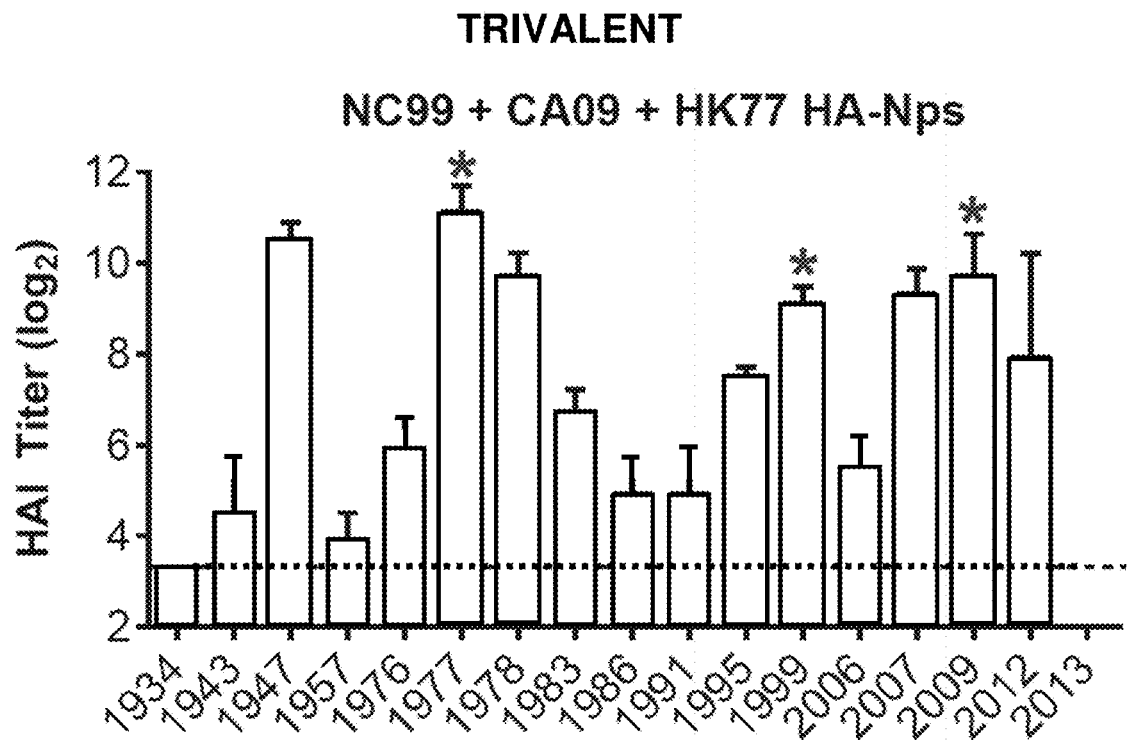
Figure 46F:
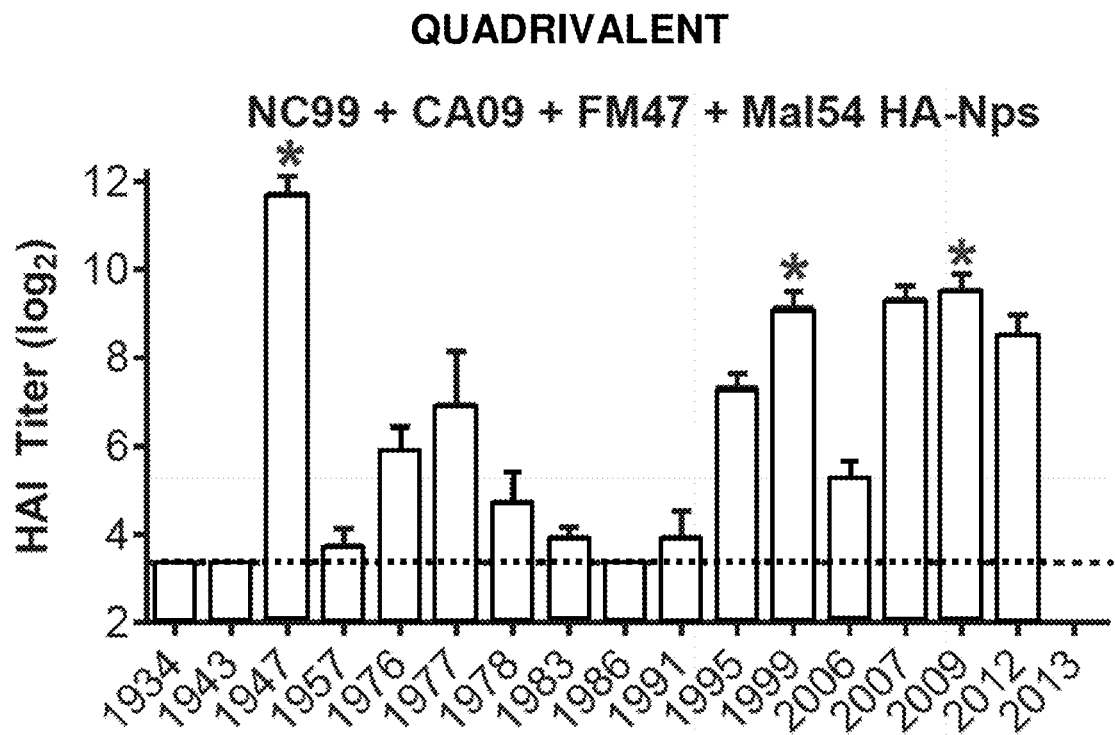
Figure 46G:
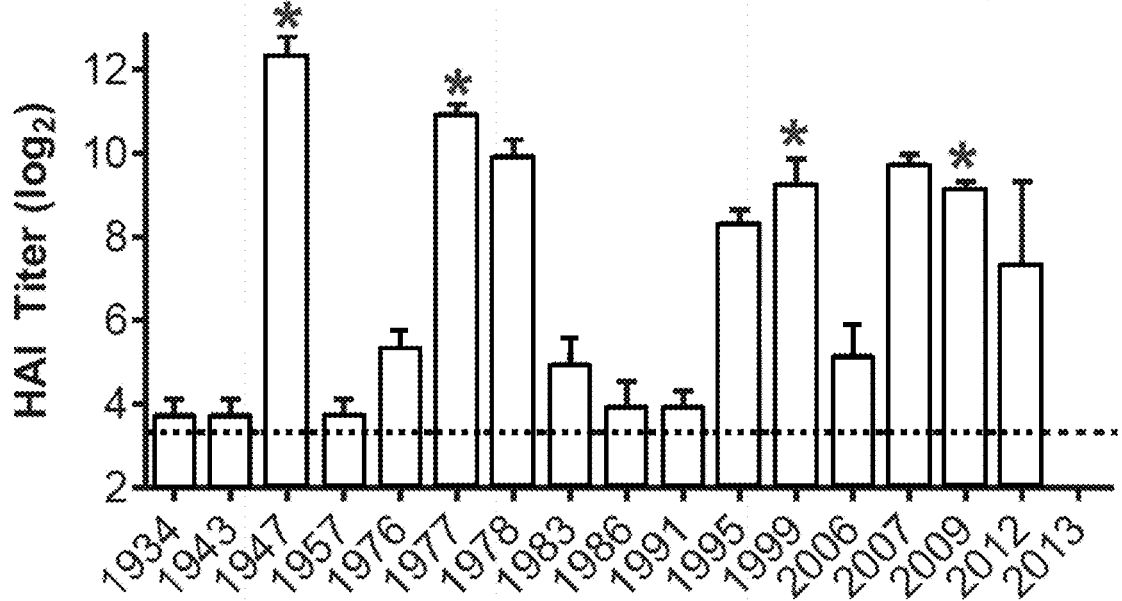
Figure 46H:
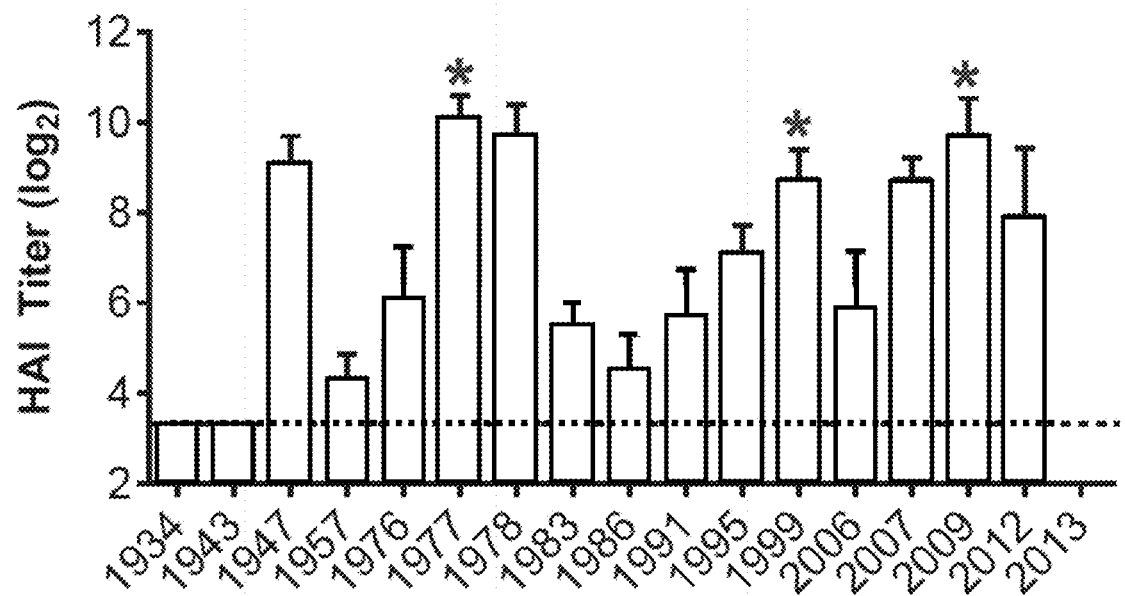
Figure 47C:
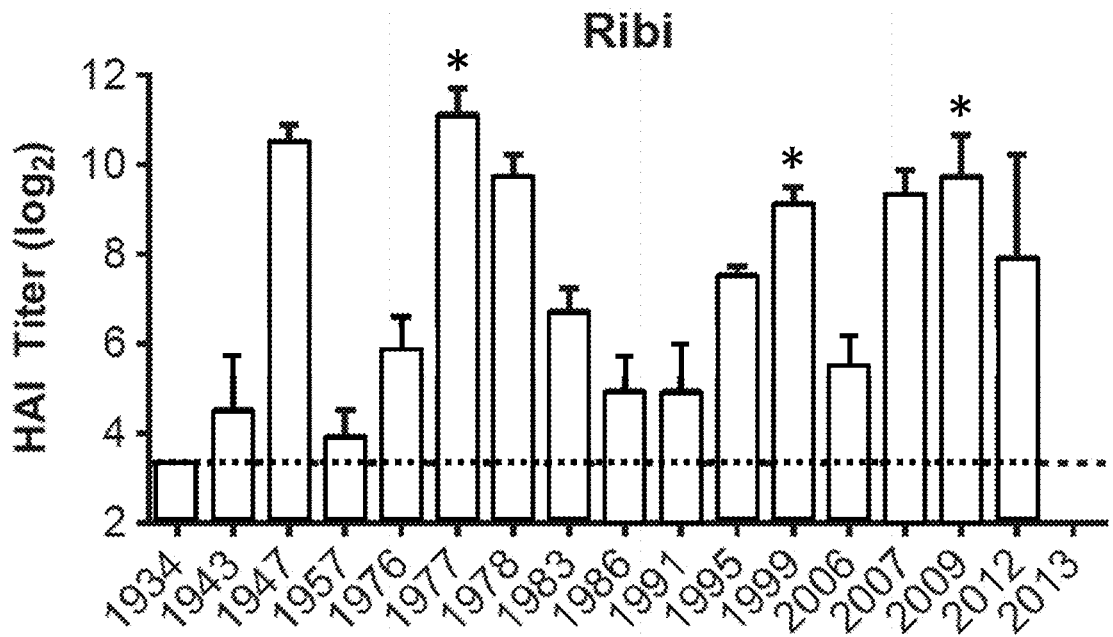
Figure 47D:
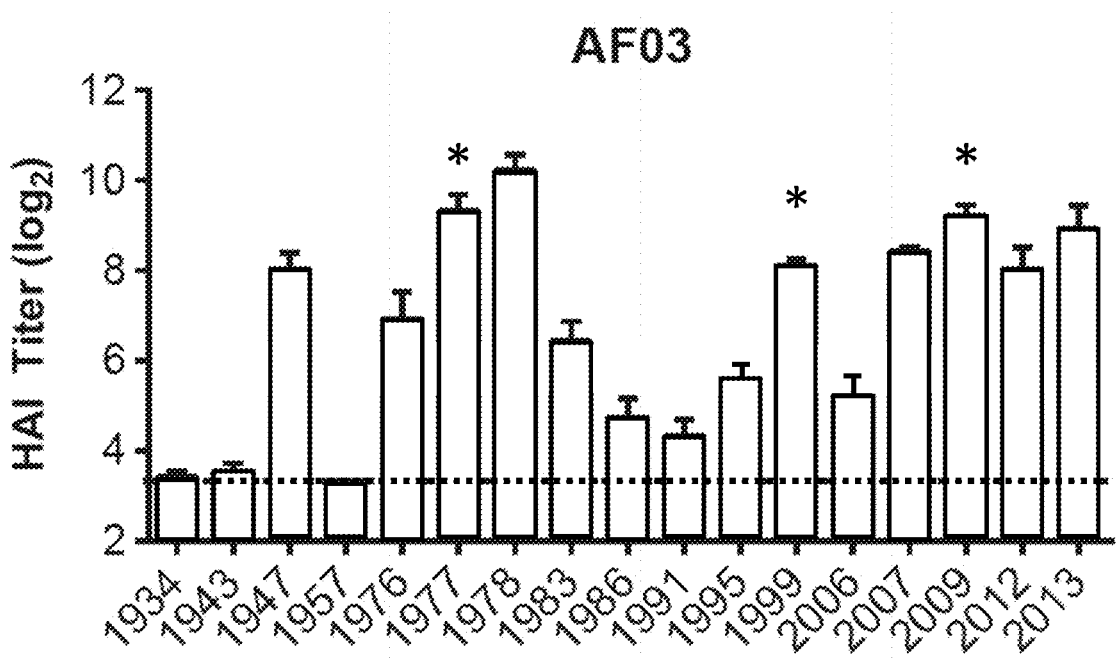
Figure 47E:
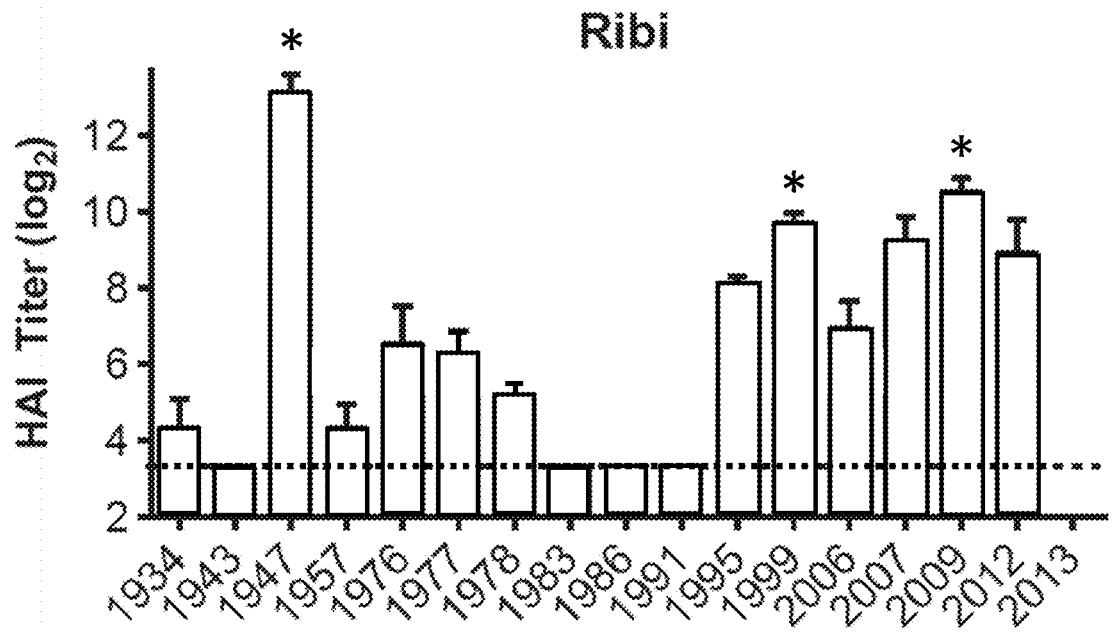
Figure 47F:
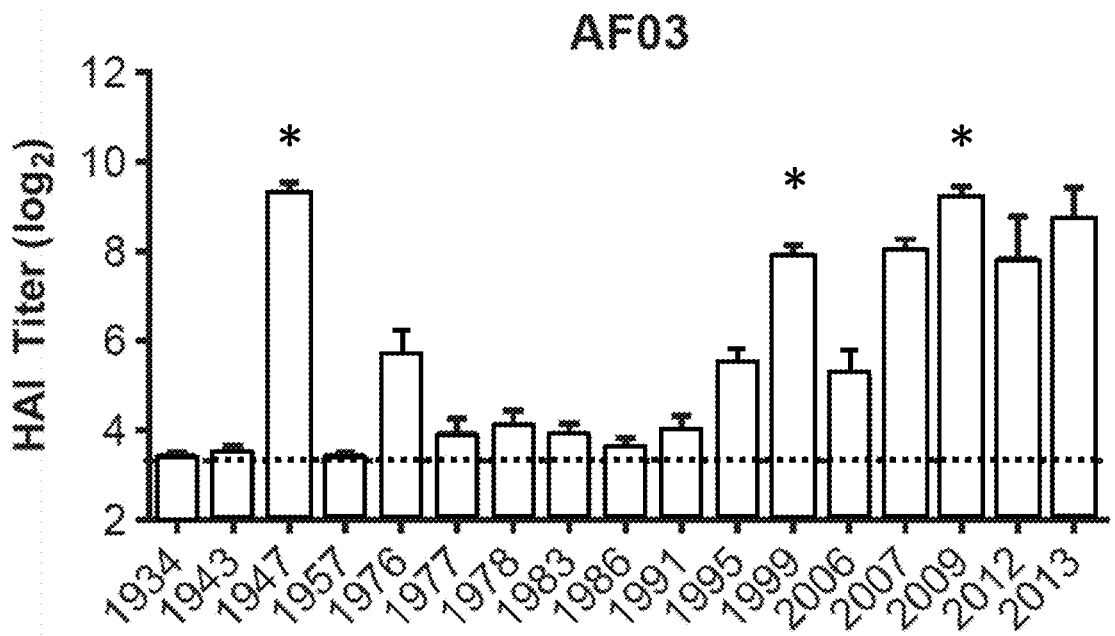

Example 12: Monovalent, Bivalent, Trivalent and Quadrivalent Formulation of HA-Ferritin Nanoparticles The HAI cross-reactivity elicited by combinations of select HA-Nps was evaluated. Mice were immunized and tested as described above with bivalent, trivalent or quadrivalent formulations made by combining individual nanoparticles. The bivalent combination of NC99 and CA09 HA-Nps showed expanded cross-reactivity relative to either monovalent composition (FIG. 46A). However, this bivalent combination did not elicit detectable antibody titers against the older divergent strains from 1934-1957 and 1977-1991. The immunogenicity of the COBRA X6 and COBRA P1 bivalent combination followed the same trend (FIG. 46B). This combination showed increased breadth compared to the NC99/CA09 bivalent composition, although HAI titers against several strains were moderate. For the trivalent combinations, inclusion of a third component to NC99 and CA09 HA-Nps increased cross-reactivity when the third component was either FM47 HA-Np (FIG. 46C) or HK77 HA-Np (FIG. 46E), but MAL54 HA-Np (FIG. 46D) did not enhance breadth. Addition of a fourth component in the quadrivalent formulations, resulted in no additional observable cross-reactivity compared to the trivalent combination of NC99, CA09, and HK77 HA-Nps (FIGS. 46F-46H).

Figure 48A:
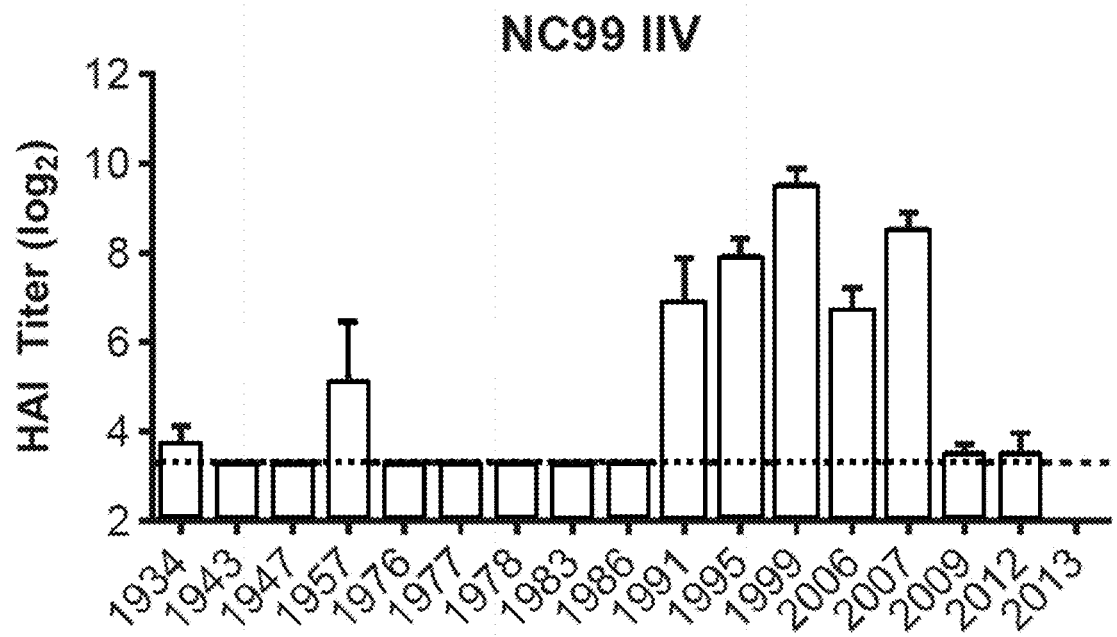
FIGS. 48A-48C. Comparative antibody response elicited by NC99 and CA09 inactivated influenza vaccines (IIV) produced in eggs as measured by assays of HAI titers.
Figure 48B:
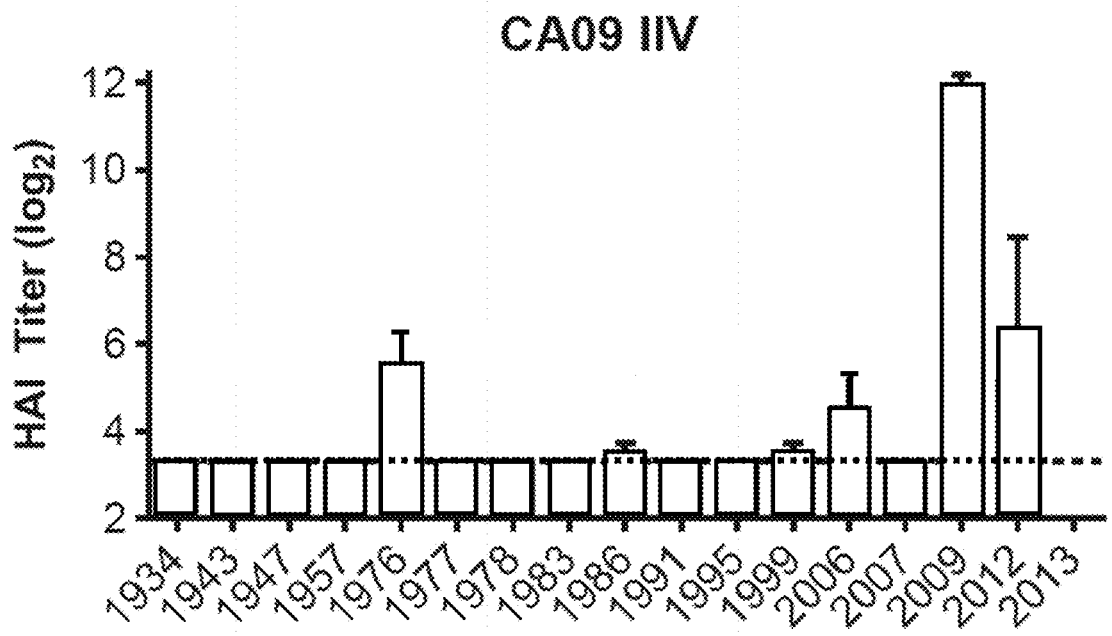
Figure 48C:
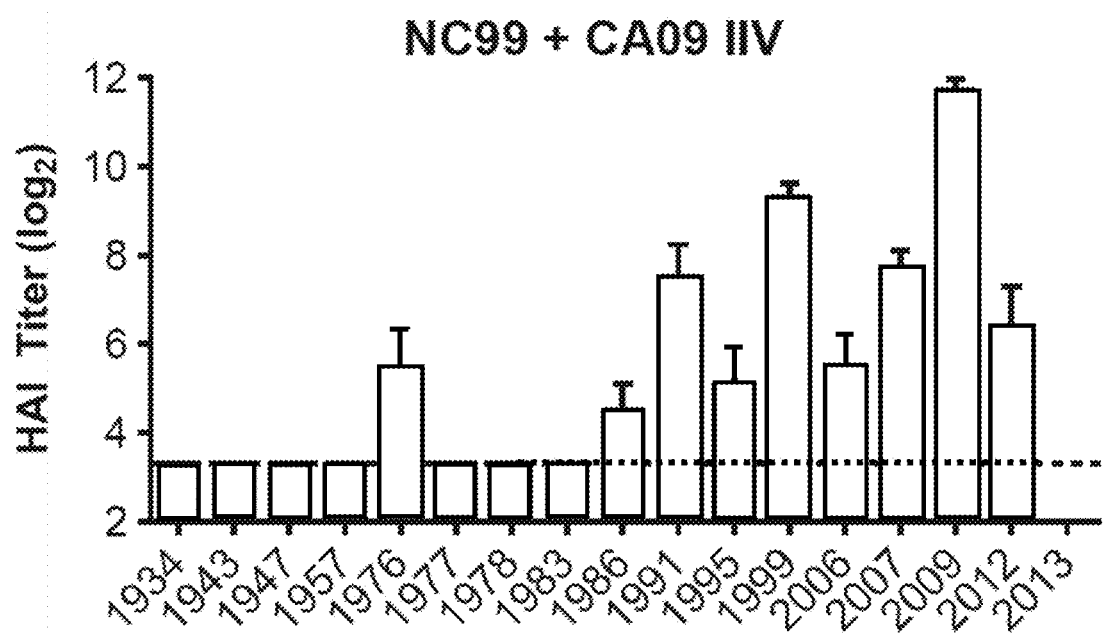

Comparable results were observed when different adjuvants were used (i.e., Ribi versus AF03, FIGS. 47A-47F). Importantly, there was no evidence for antigenic competition by co-administration of different HA-Nps. These data suggest that cross-reactivity profiles are additive for cases in which there is a high degree of complementarity in their individual HAI profiles. HAI profiles obtained with NC99 and CA09 immunogens delivered as egg-produced inactivated influenza vaccines (IIV) using a normalized dose of HA were also measured (FIGS. 48A-48C).

Figure 49A:
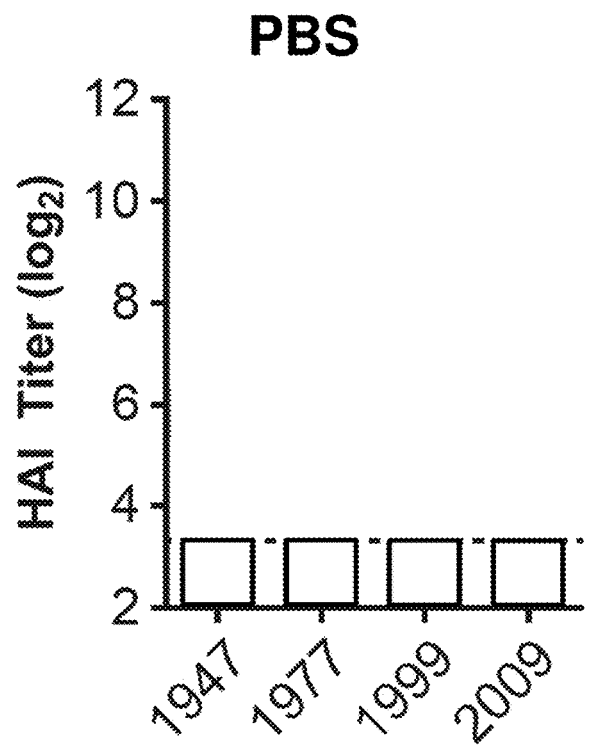
FIGS. 49A-49D. Antibody responses against various influenza viruses following immunization of ferrets using HA-ferritin nanoparticle compositions or IIV, as measured by assays of HAI titers. HAI titers ($\log_2$) of serum from ferrets (n=12 per group) following two immunizations with the following admixed with AF03 adjuvant.

Example 13: Protection Against Challenge with Nanoparticle Compositions in Ferrets The efficacy of certain HA-Np combinations were tested in ferrets, an animal model relevant to human disease. Ferrets were immunized (n=12 per group) with either phosphate buffered saline (FIG. 49A), CA09 inactivated influenza vaccine (IIV, FIG. 49B), a trivalent combination of wild-type HA-Nps (NC99+CA09+HK77, FIG. 49C) or a combination of COBRA P1+COBRA X6+HK77 HA-Nps (FIG. 49D). Before intramuscular injection, these compositions were mixed 1:1 with AF03 adjuvant for a 1-ml final injection volume.

Figure 49B:
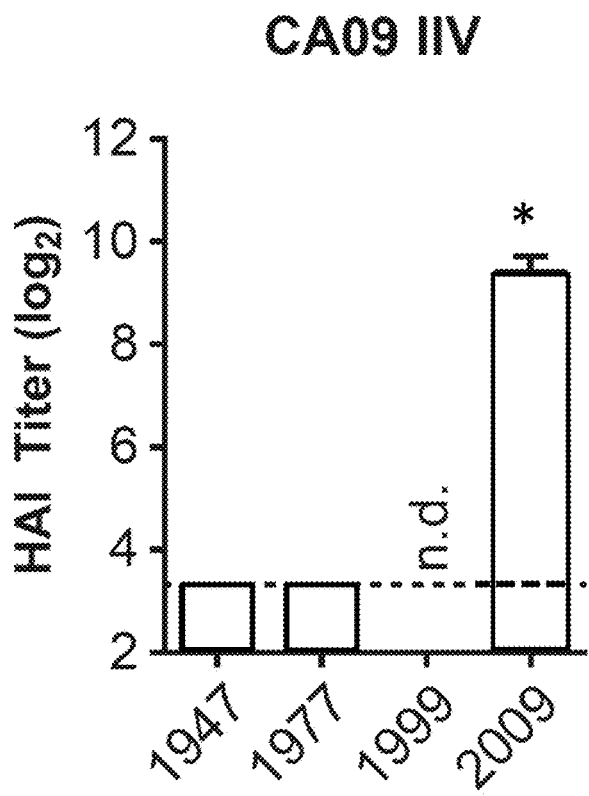
Figure 49C:
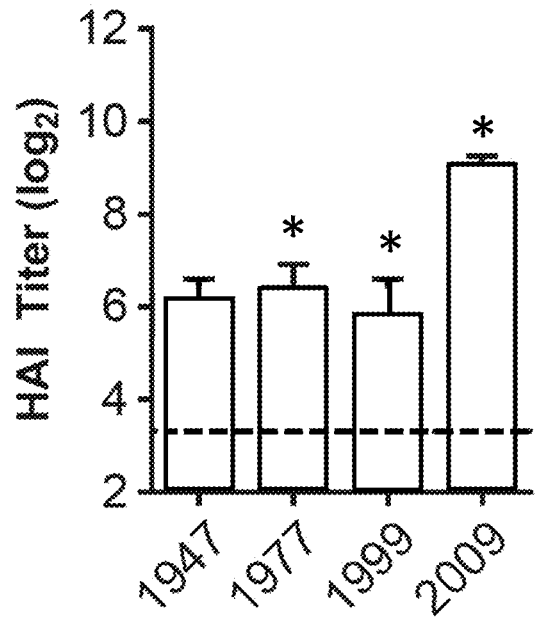
Figure 49D:
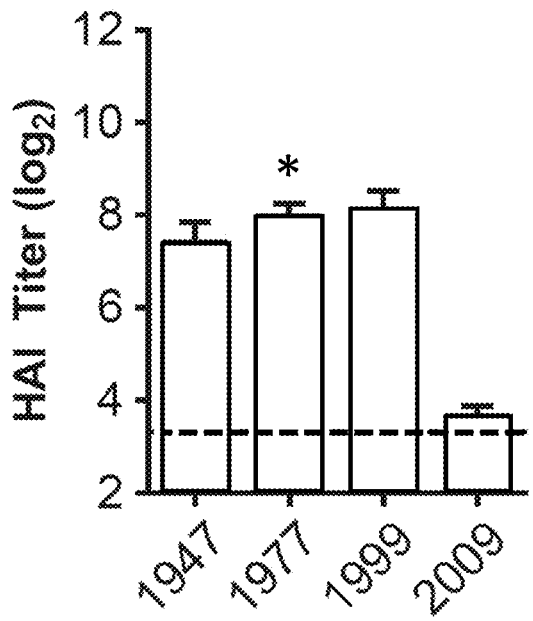

After two immunizations, significant HAI titers against the matched strains were observed (FIGS. 49B-49D). Both groups of ferrets immunized with nanoparticle combinations showed significant HAI titers against FM47, HK77 and NC99. CA09 IIV did not elicit cross-neutralizing titers against FM47 and HK77 strains in ferrets (FIG. 49B), as observed in mice.

Figure 49E:
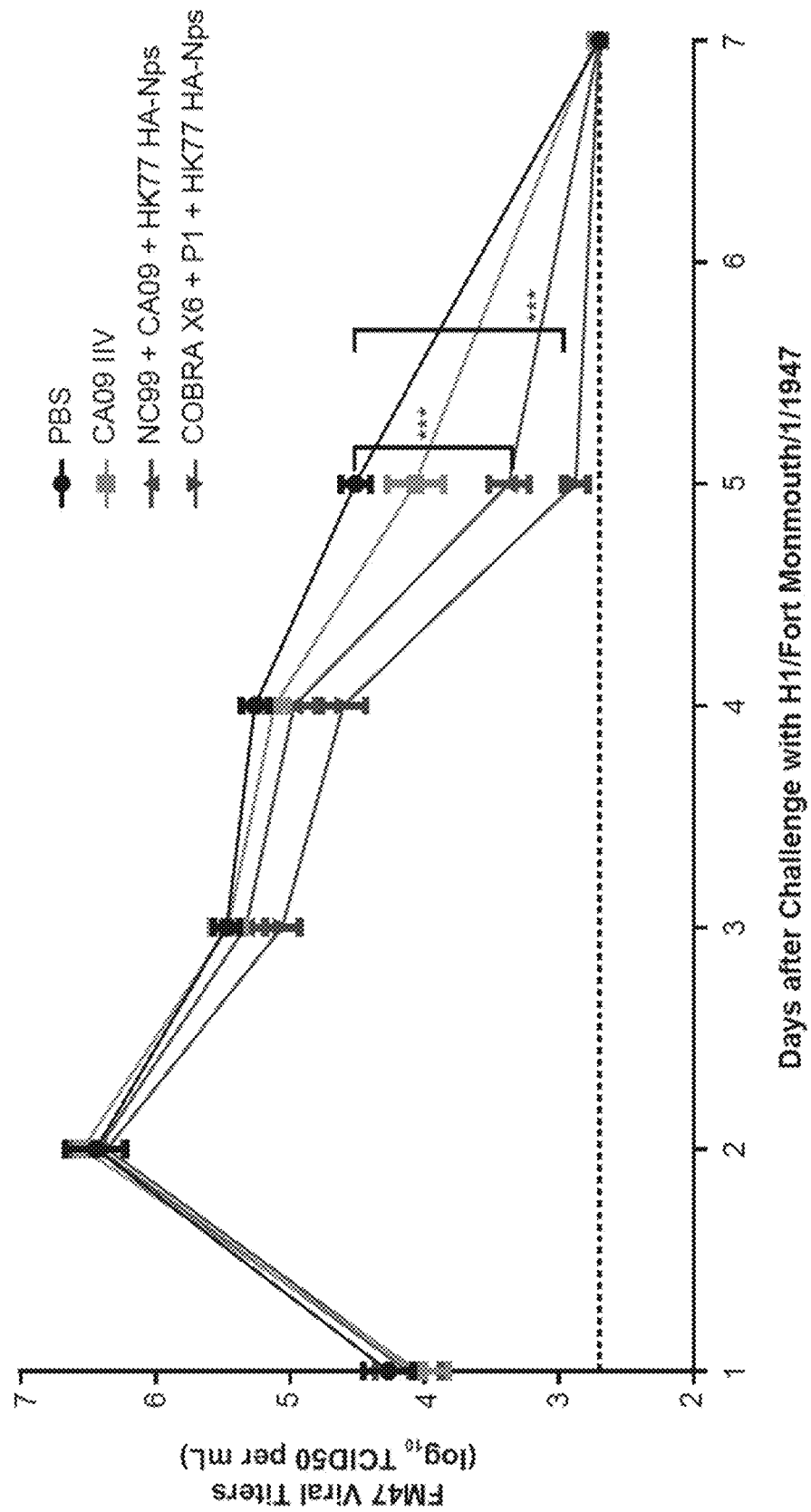
FIG. 49E. Heterologous challenge of ferrets immunized with HA-ferritin nanoparticle compositions, IIV, or PBS. Ferrets were immunized as described for FIGS. 49A-D and challenged with 1947 Fort Monmouth virus 4 weeks after the last immunization by intranasal inoculation with 1 mL of A/Fort Monmouth/1/1947 virus at $10^{4.65}$ times the 50% tissue culture infectious dose (TCID50). Virus titers were quantified in the nasal washes over a seven-day time-course after challenge. Dashed line indicates the assay limit of detection. Viral titers were significantly reduced at day 5 post-challenge in ferrets immunized with HA-Nps combinations, but not with CA09 IIV, as compared to vehicle (PBS) control by one-tailed unpaired t-test and by one-way ANOVA [$F(3,44)=5.18$, $p=0.00375$]. ***=$p \leq 0.001$, by Student's t-test.
Figure 50A:
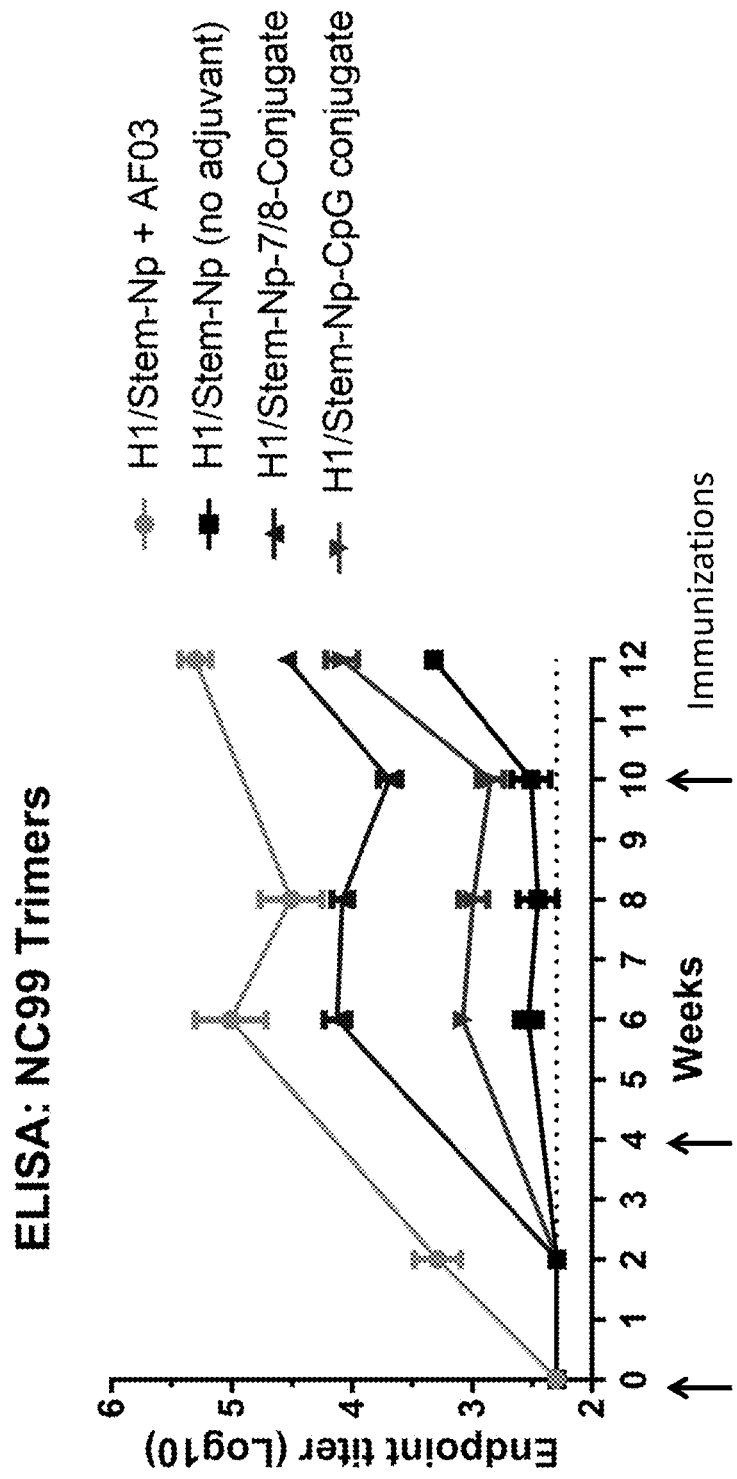
FIG. 50A-C. Antibody response of Cynomolgus macaques (*Macaca fascicularis*) following immunization with 50 μg of H1/Stem-Np formulated with admixed AF03 adjuvant, or 200 μg H1/Stem-Np (no adjuvant control), or 200 μg of H1/Stem-Np-SM7/8a conjugate (shown in FIG. 28A) or 200 μg of H1/Stem-Np-CpG conjugate (shown in FIG. 28B).
Figure 50C:
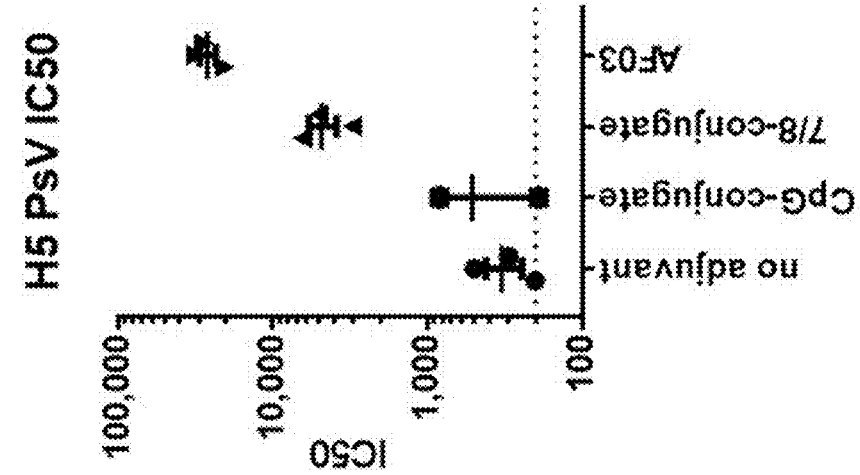
Figure 50B:
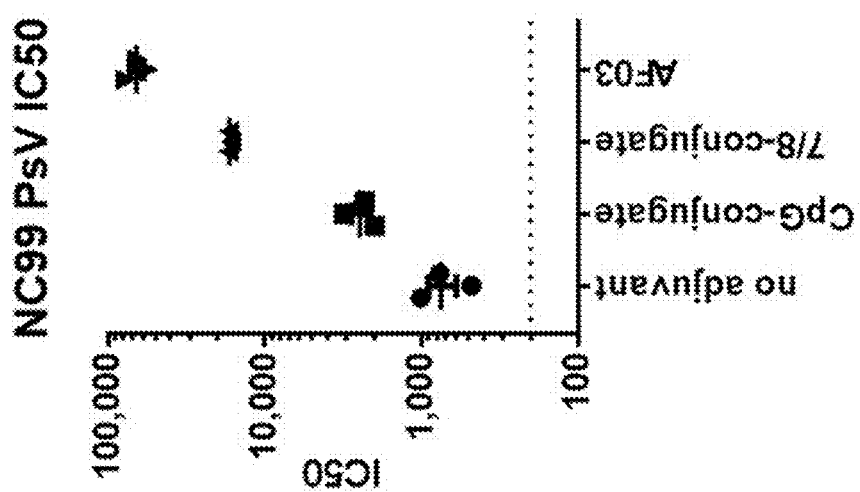
Figure 51A:
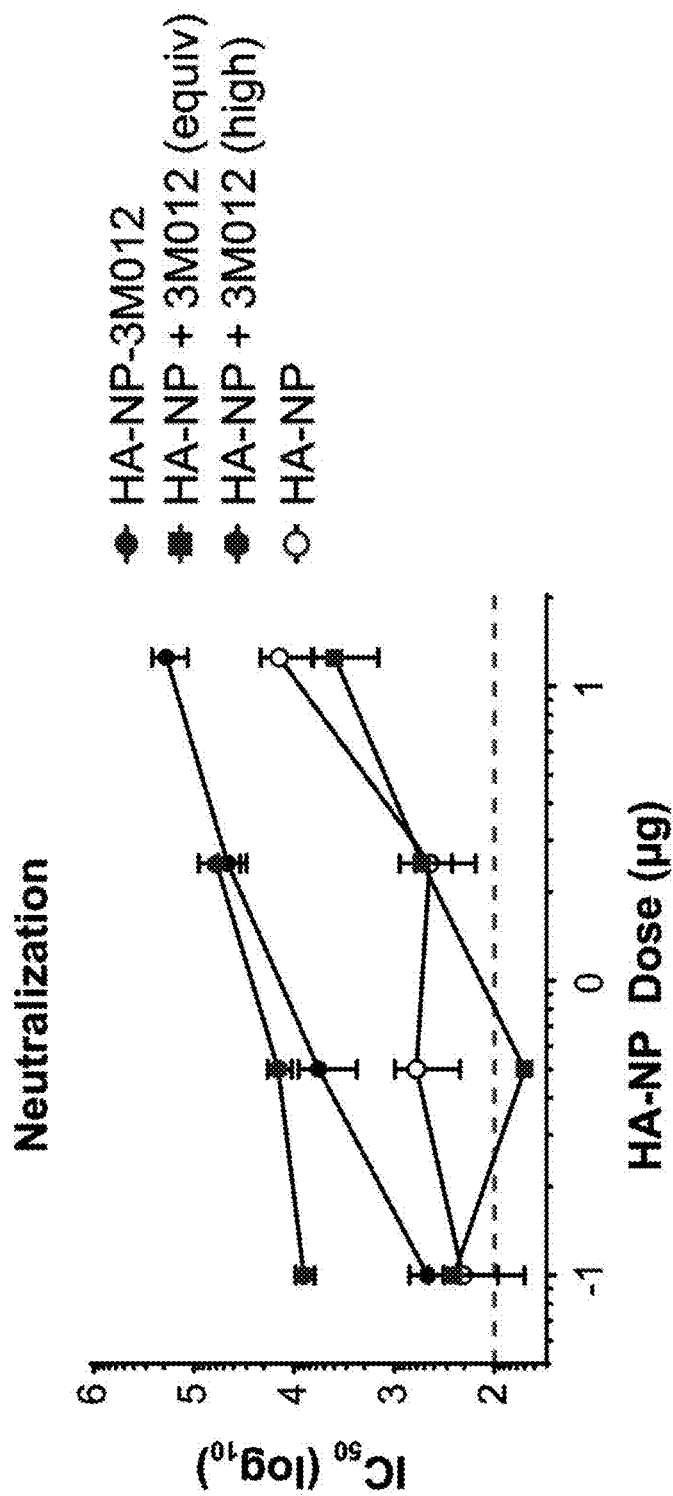
FIGS. 51A-51B. Comparison of tit
Figure 51B:
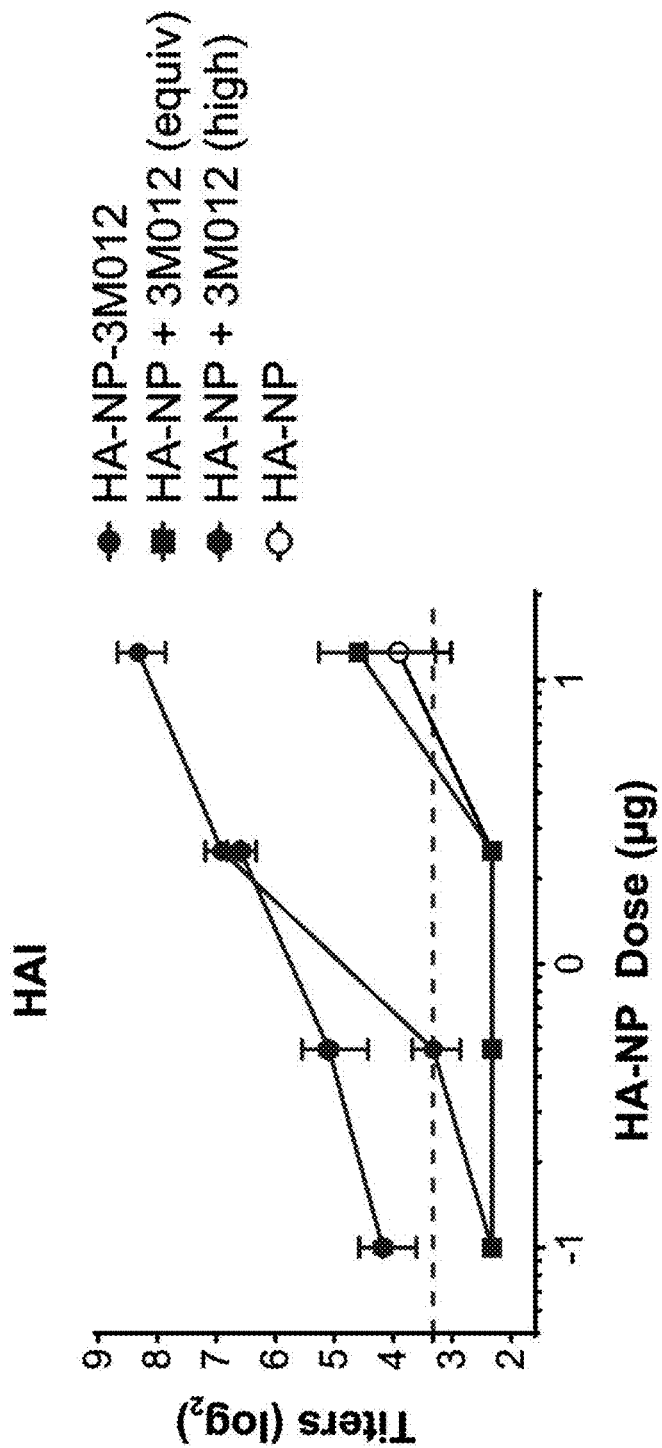

After immunization, the ferrets were challenged with an unmatched divergent strain, H1/Fort Monmouth/1947 virus. The influenza challenge was performed 4 weeks after the second immunization by intranasal inoculation with 1 ml of A/Fort Monmouth/1/1947 virus with $10^{4.65}$ times a 50% tissue culture infectious dose (TCID50). Clinical signs were followed daily for 2 weeks and nasal washes were collected daily for 7 days post challenge and tested for viral load by a standard $TCID_{50}$ assay. Viral titers were quantified from nasal washes following the challenge. The ferret cohorts that received either trivalent NC99+CA09+HK77 or COBRA-P1+X6+HK77 nanoparticle combinations cleared the virus faster than the control group, displaying significantly reduced viral titers at day 5 post-infection (FIG. 49E, p<0.001). In contrast, the CA09 IIV-immunized group did not clear virus significantly faster than the PBS-immunized control group. In all groups, the FM47 strain successfully replicated and was cleared no later than one week after infection. Thus, in an animal model of infection relevant to human disease, the trivalent combinations stimulated effective HAI responses that also protect against divergent viral challenge.

Example 14: Antigenic EBV Polypeptides for Eliciting Antibodies Against EBV

Antigenic polypeptides that elicit antibodies against EBV were developed. Self-assembling ferritin nanoparticles were developed that display EBV gL and gH polypeptides as a single-chain, and the immunogenicity of these nanoparticles in mice was evaluated.

Figure 52A:
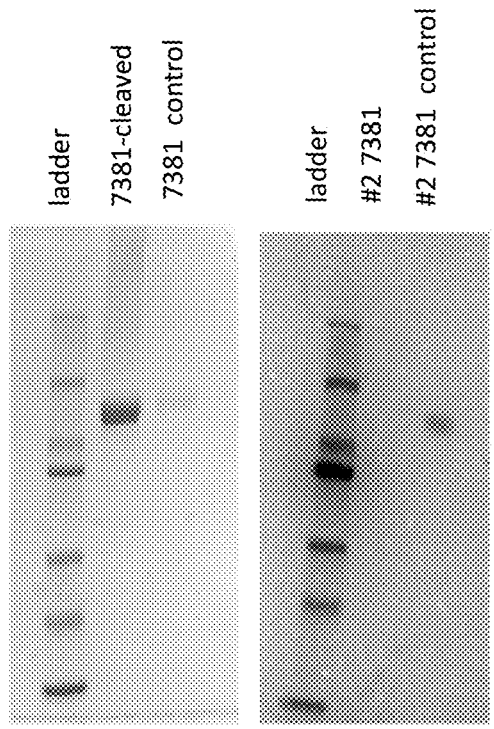
Figure 52B:
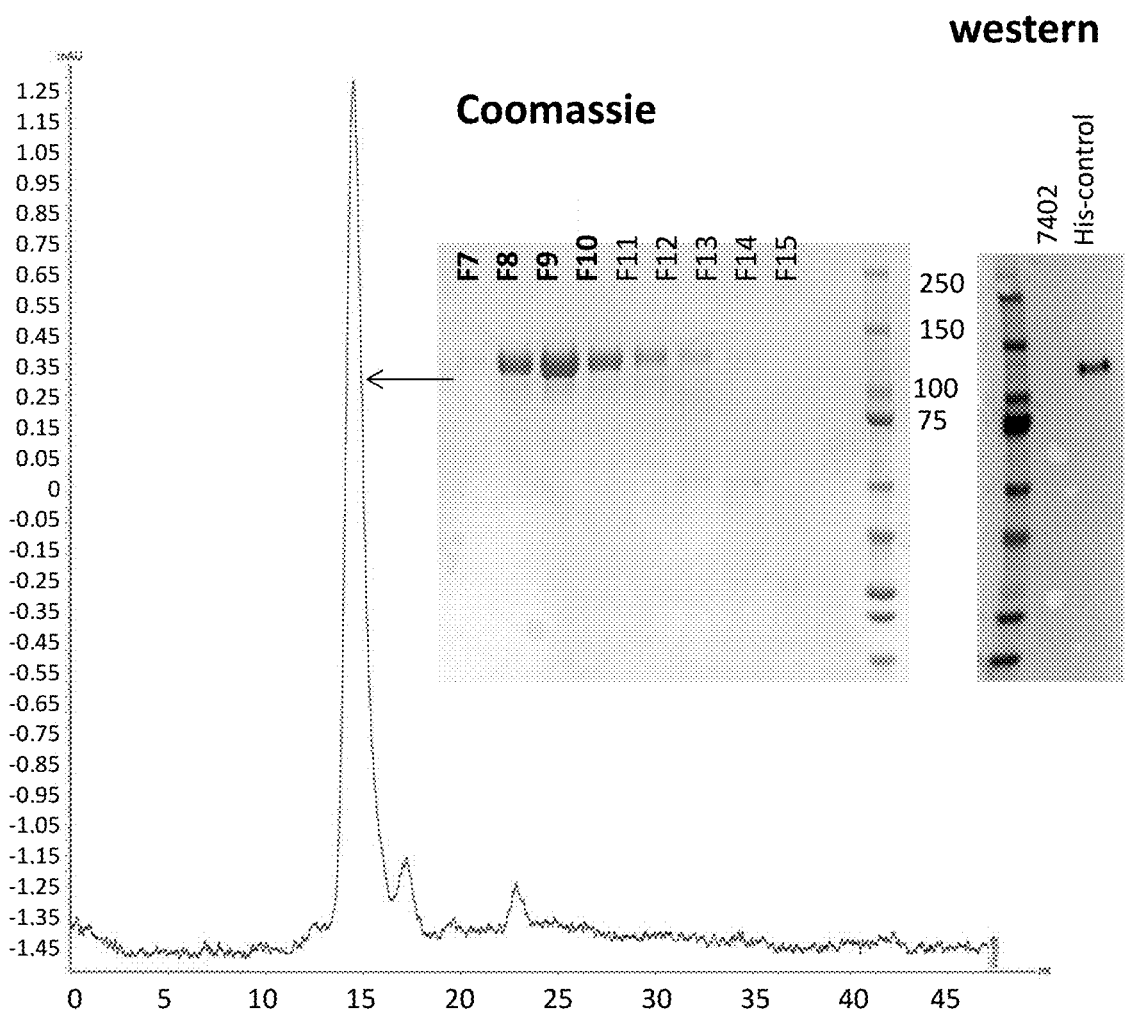
Figure 53A:
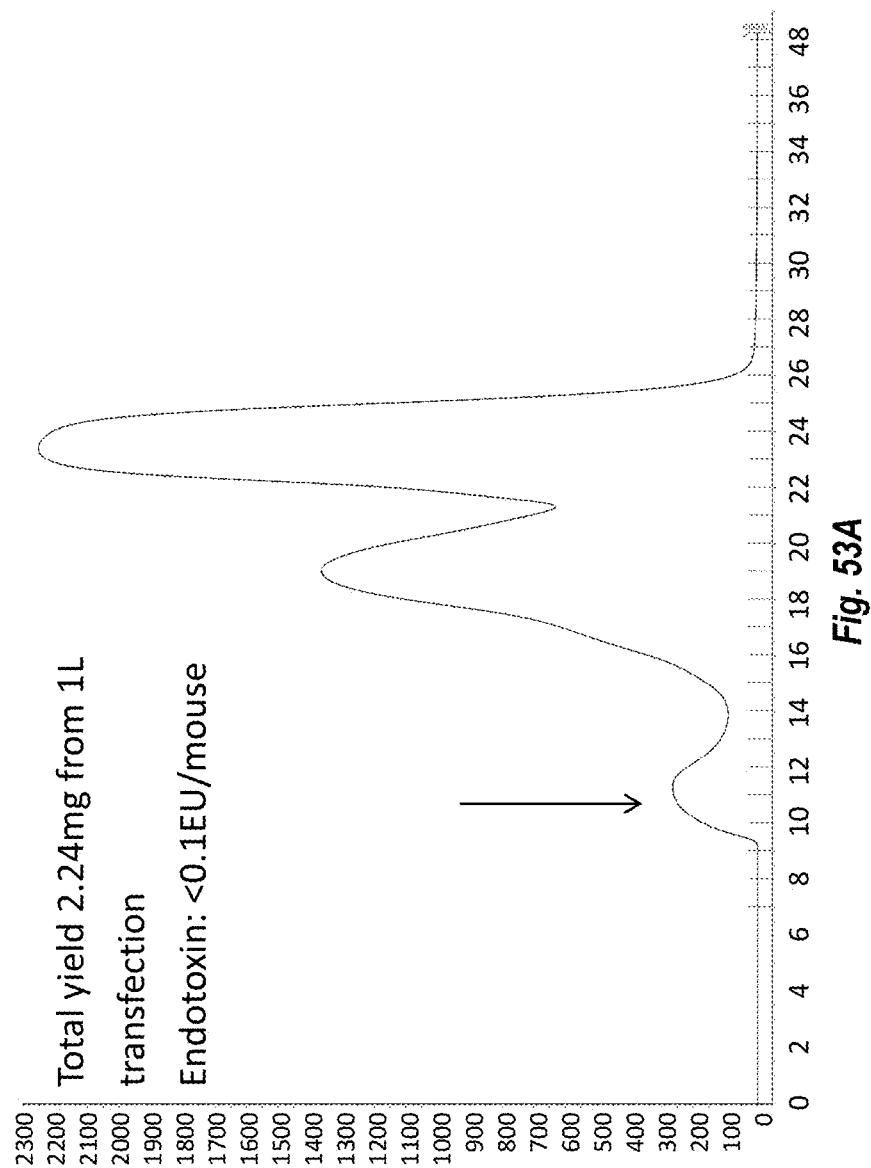
Figure 53B:
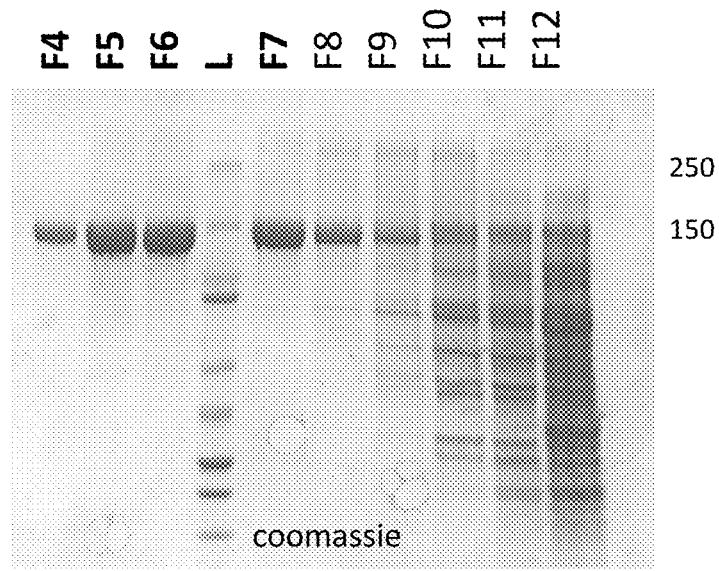
Figure 53C:
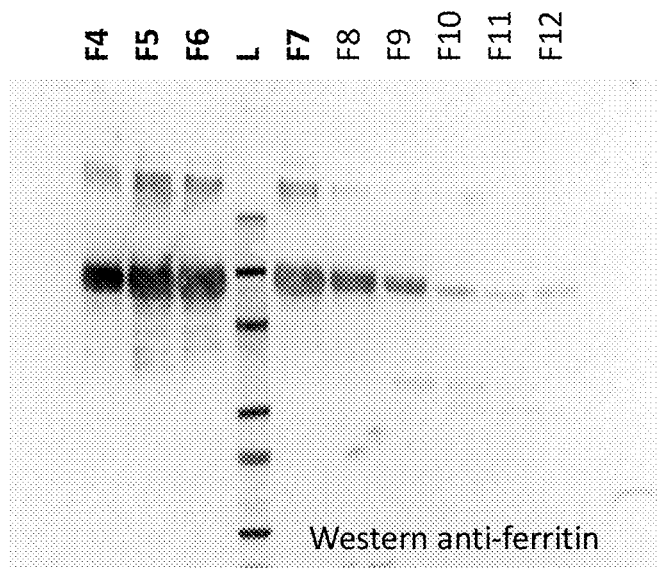
Figure 53D:
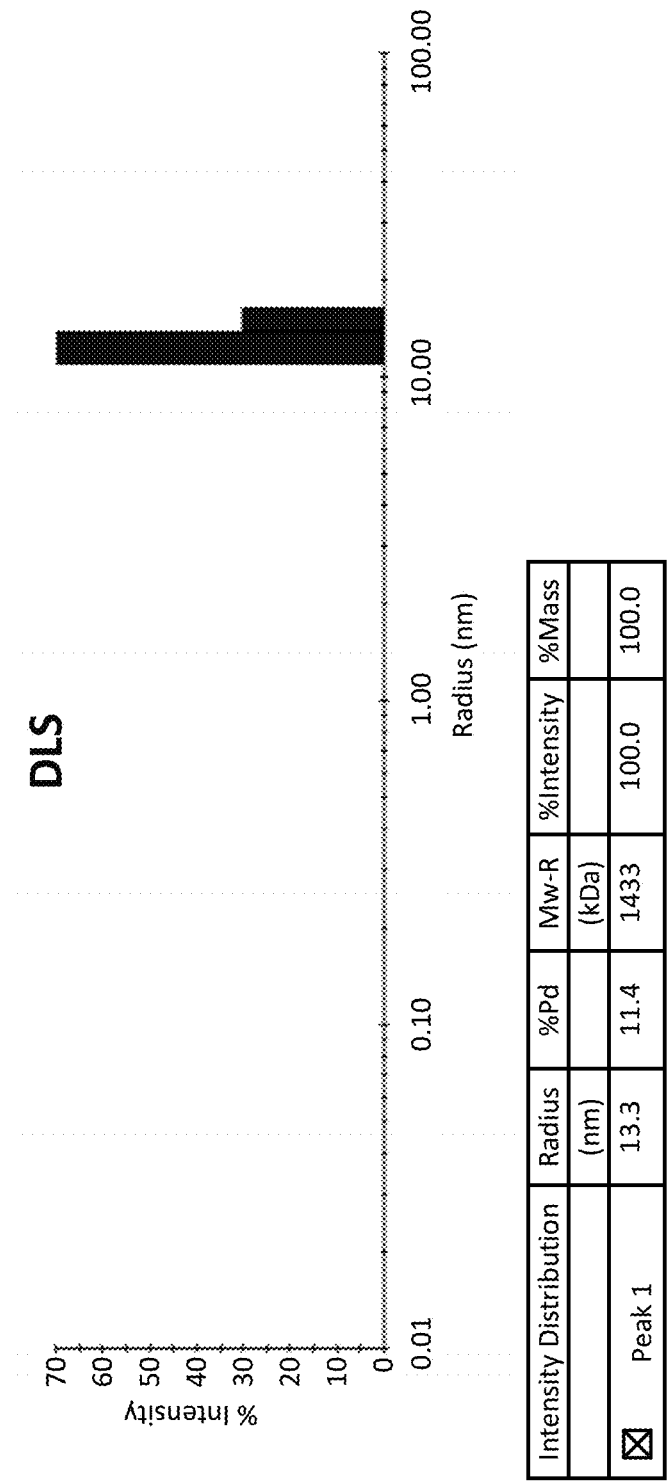
Figure 53E:
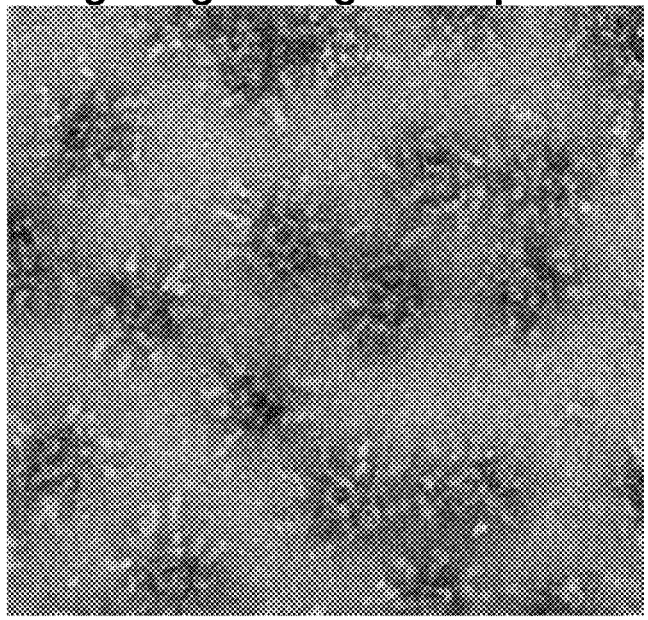

Monomeric and trimeric gL/gH constructs were expressed and purified. FIG. 52A shows single-chain gL and gH monomer (SEQ ID NO: 406)+/–His-tag cleavage by Coomassie and western blot (anti-His) analysis. FIG. 52B shows fractionation of a gL and gH trimer (SEQ ID NO: 411) on a Superose® SEC column as an absorbance trace and by Coomassie, along with a western blot to confirm His-tag cleavage by thrombin protease. The final concentration of samples was 1 mg/mL, the total volume was 15 mL, and the endotoxin level was 1.48 EU/mL for the SEQ ID NO: 406 construct.

Single-chain gL/gH ferritin nanoparticles (SEQ ID NO: 414) were expressed and purified. FIGS. 53A-53E show purification and characterization thereof by Superose® 6 SEC fractionation (53A), Coomassie of SEC fractions (53B), western blot of SEC fractions with anti-ferritin primary Ab (53C), dynamic light scattering (DLS, 53D), and electron microscopy (53E).

Figure 54:
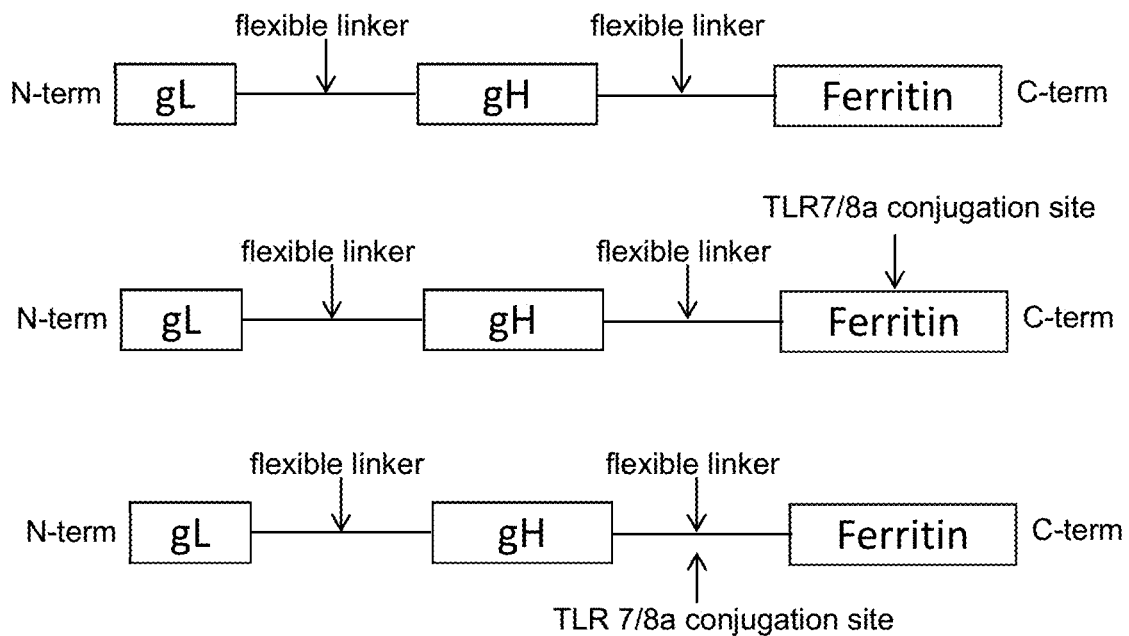
Figure 55:
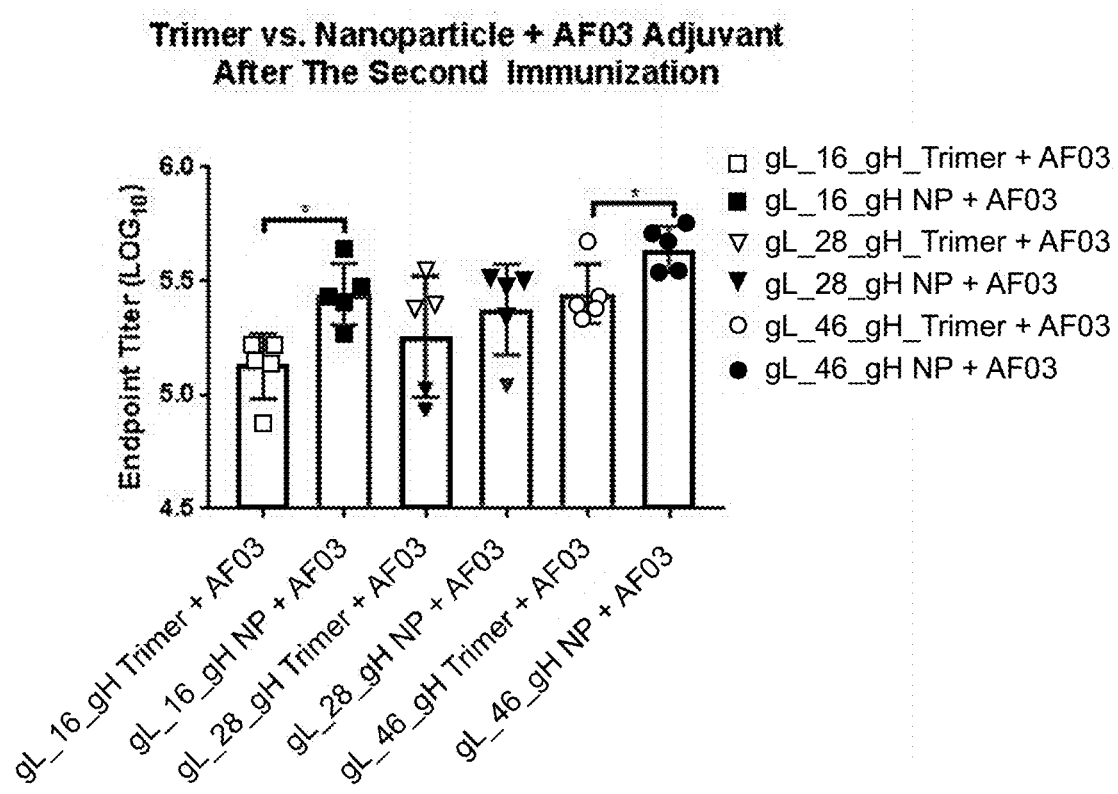

Exemplary constructs of single-chain EBV gL and gH fused to ferritin are shown in FIG. 54. A conjugation site for an immune-stimulatory moiety, such as a toll-like receptor 7/8 agonist (TLR7/8a), can be present either on the ferritin or in the linker (see, e.g., SEQ ID NOS: 414, 419, 422, 420, 423, and 433 for exemplary sequences).

gL/gH trimers or nanoparticles with different linkers were injected into mice and immune sera were assessed (FIG. 55). Mice were given two 2-µg injections with adjuvant AF03, a squalene emulsion-based adjuvant, with a 3-week interval between doses. Anti-gL/gH antibody endpoint titers were measured by ELISA at week 6. For gH_16_gL, a nanoparticle (SEQ ID NO: 410) outperformed a trimer construct (SEQ ID NO: 416). The gL_28_gH nanoparticle (SEQ ID NO: 413) did not perform significantly differently from the trimer construct (SEQ ID NO: 411). The gL_46_gH nanoparticle (SEQ ID NO: 414) outperformed the gL_46_gH trimer (SEQ ID NO: 412).

These data indicate that single-chain gL/gH nanoparticles can elicit a robust immune response against EBV.

Example 15: Bivalent Immunization Against gL/gH and Gp220

Figure 56A:
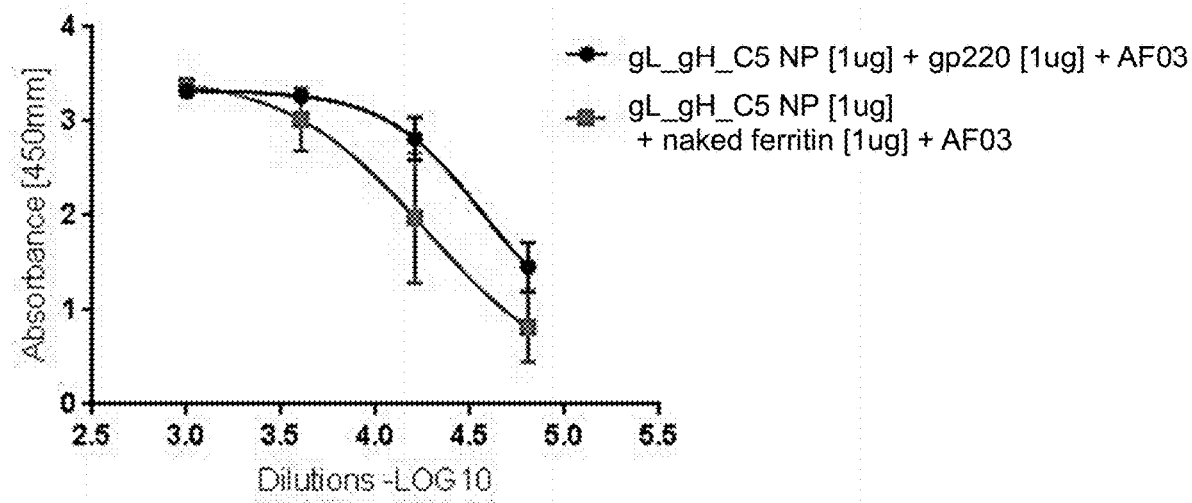
Figure 56B:
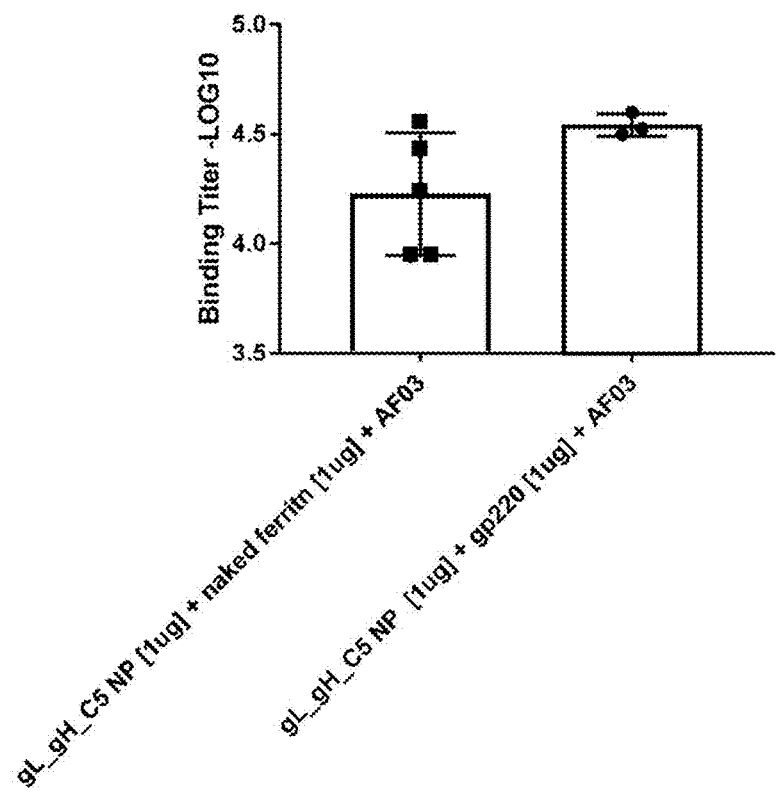
Figure 57A:
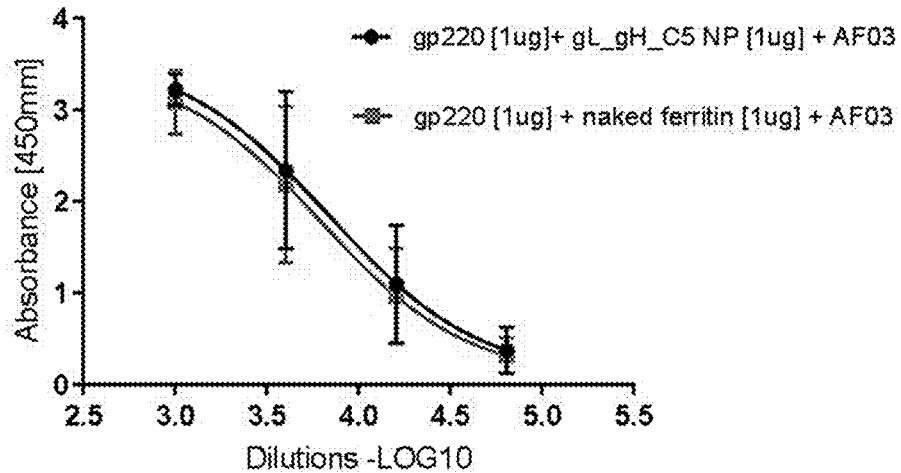
Figure 57B:
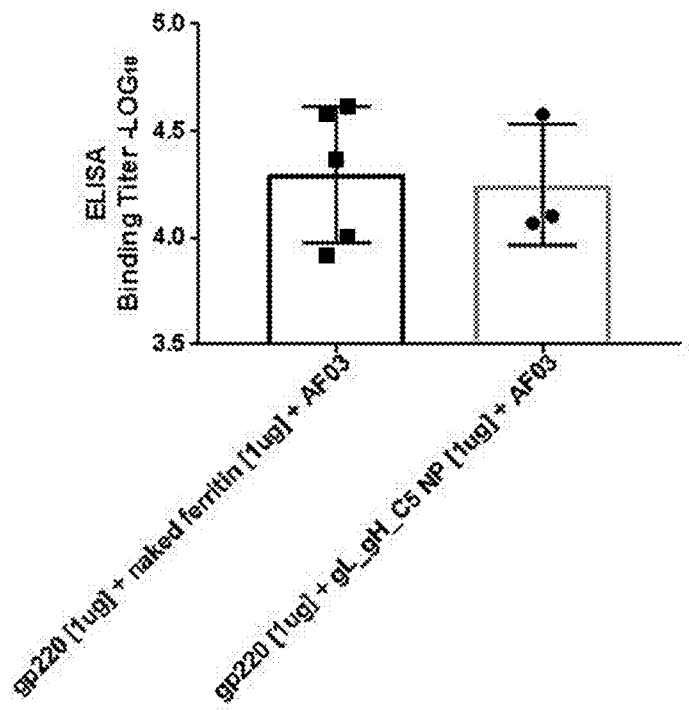

Bivalent immunization was performed using compositions comprising single-chain gL/gH nanoparticles and gp220 nanoparticles. Including the gp220 nanoparticles (SEQ ID NO: 401) had no significant interfering effect on the immune response elicited by single-chain gL/gH nanoparticles (gL-gH_C5 NP [SEQ ID NO: 419]), as measured by an ELISA binding assay using sera from mice vaccinated as described above (FIGS. 56A-56B, showing measurements at individual dilutions and binding titers, respectively). Similarly, no interference was observed in the response to the immune response to gp220 nanoparticles when administered in combination with the single-chain gL/gH nanoparticles, as measured by ELISA (FIGS. 57A-57B, showing measurements at individual dilutions and binding titers, respectively).

Thus, immunization with both a single-chain gL/gH nanoparticle and a gp220 nanoparticle did not decrease the immune response to either polypeptide.

Example 16: Conjugation of Adjuvant to Ferritin Nanoparticles

Figures 58A, 58B, 58C:
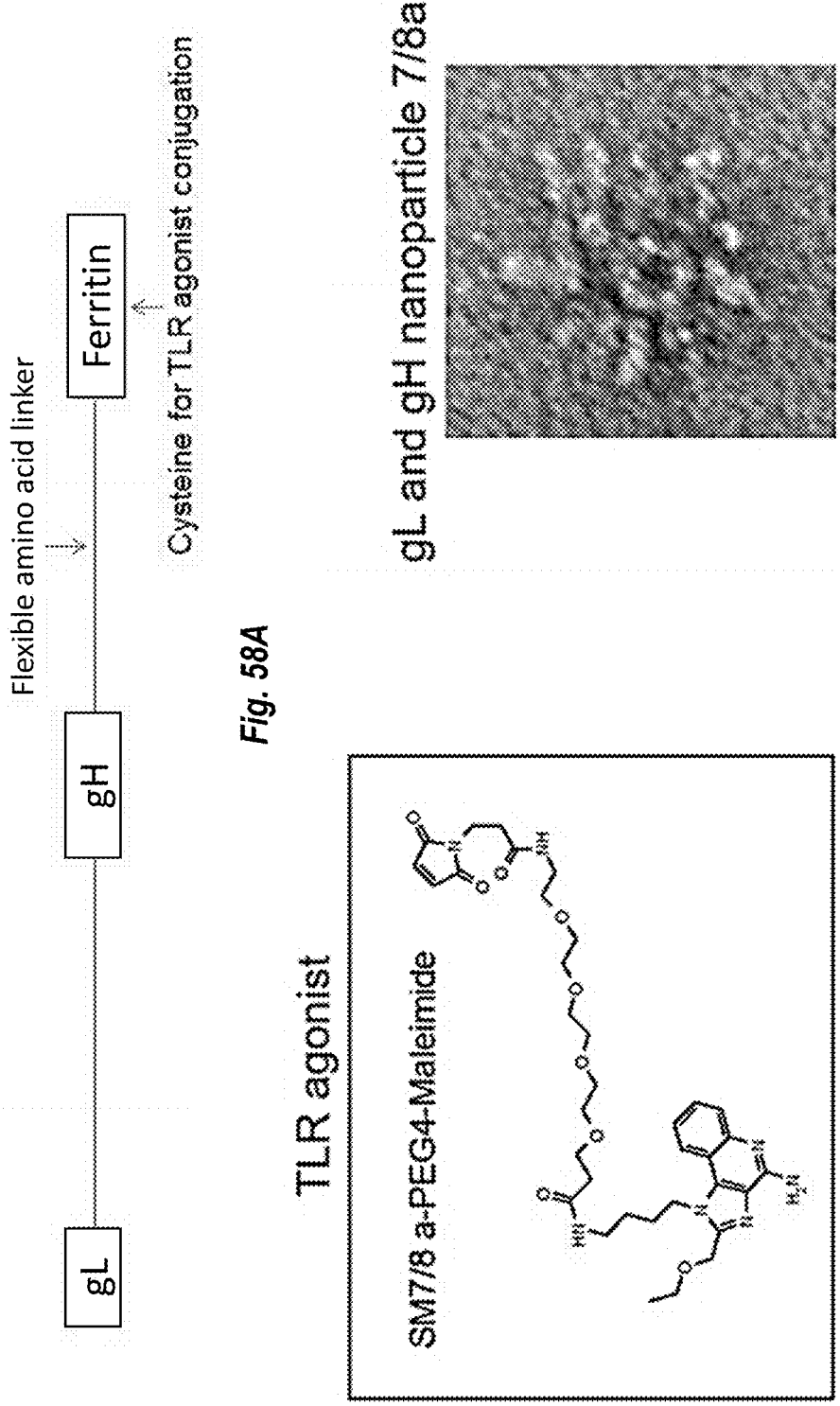

Next, conjugation of adjuvants to ferritin nanoparticles was assessed. FIG. 58A illustrates a construct in which the ferritin comprises a mutation replacing a surface-exposed amino acid with a cysteine, which is available for conjugation. FIG. 58B shows an exemplary immune-stimulatory moiety (SM7/8a, a TLR-7/8 agonist) linked to a PEG4 linker and maleimide. This maleimide can be used to covalently conjugate the linker (itself attached to SM7/8a) to the surface-exposed cysteine of the ferritin. A polypeptide comprising a single-chain gL/gH polypeptide fused to ferritin conjugated to SM7/8a is shown in the electron micrograph of FIG. 58C.

Figure 59A:
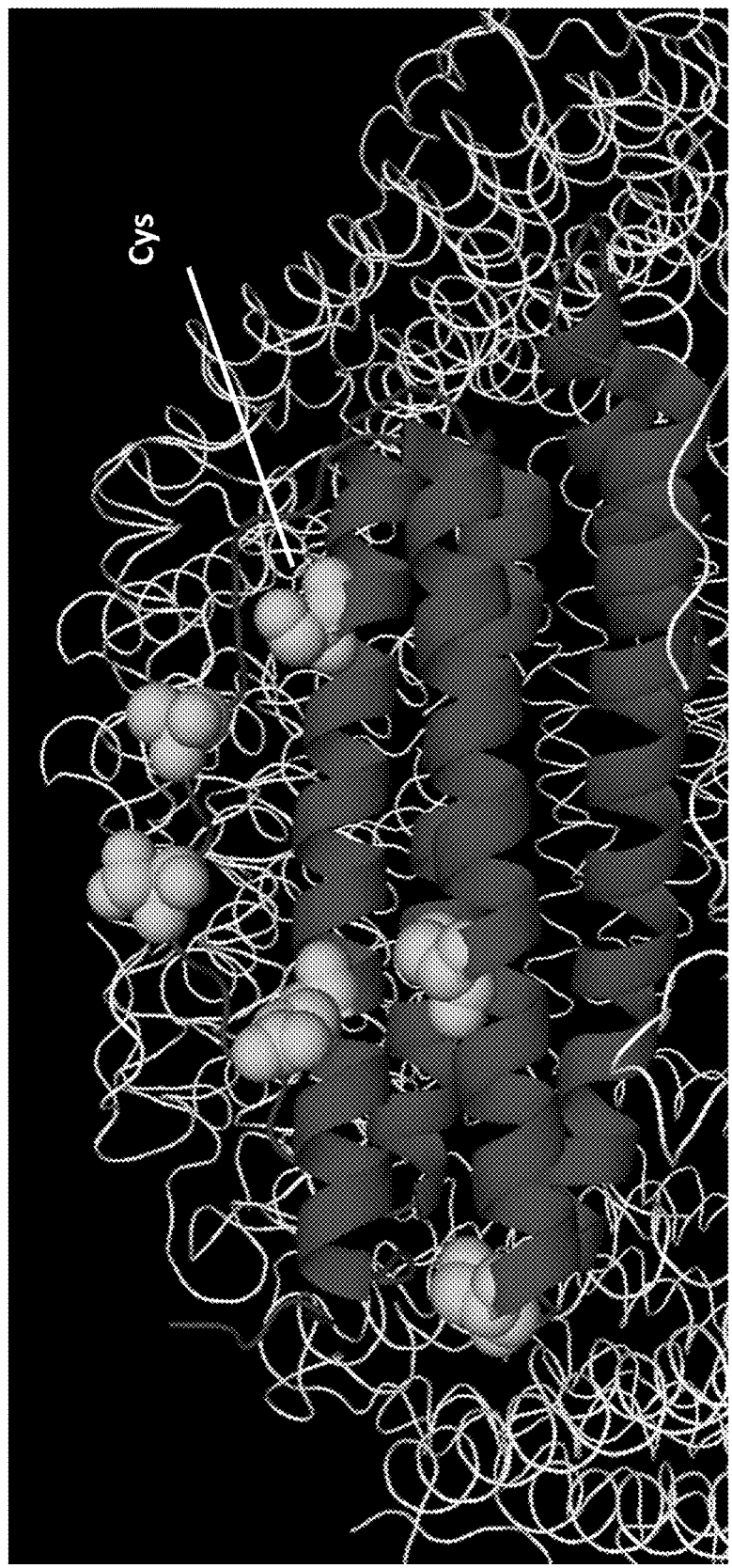
Figure 59B:
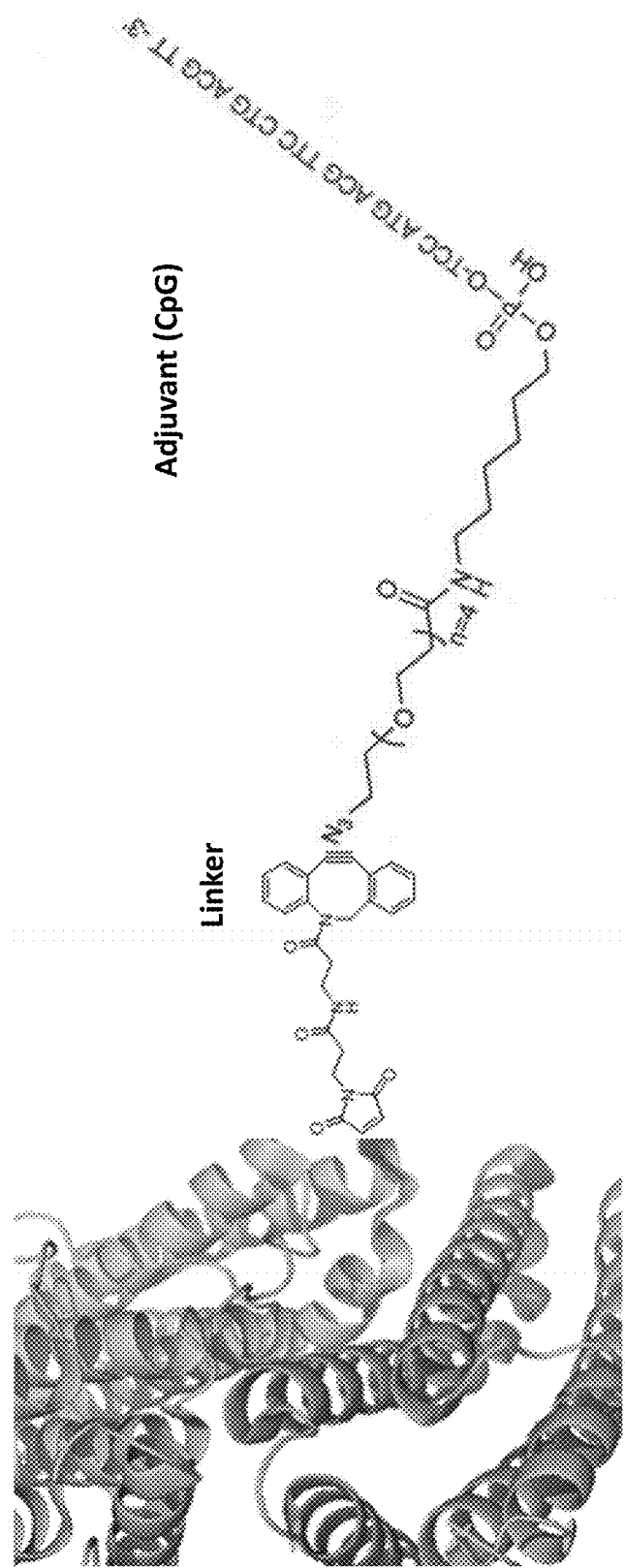

A cysteine resulting from mutation of a surface-exposed amino acid is illustrated in the structure a ferritin molecule in FIG. 59A. Conjugation of a CpG adjuvant (SEQ ID NO: 535) to ferritin is illustrated in FIG. 59B by juxtaposing the ferritin, linker, and CpG adjuvant, oriented to show the parts of each moiety that become attached to each other in proximity.

Figure 60A:
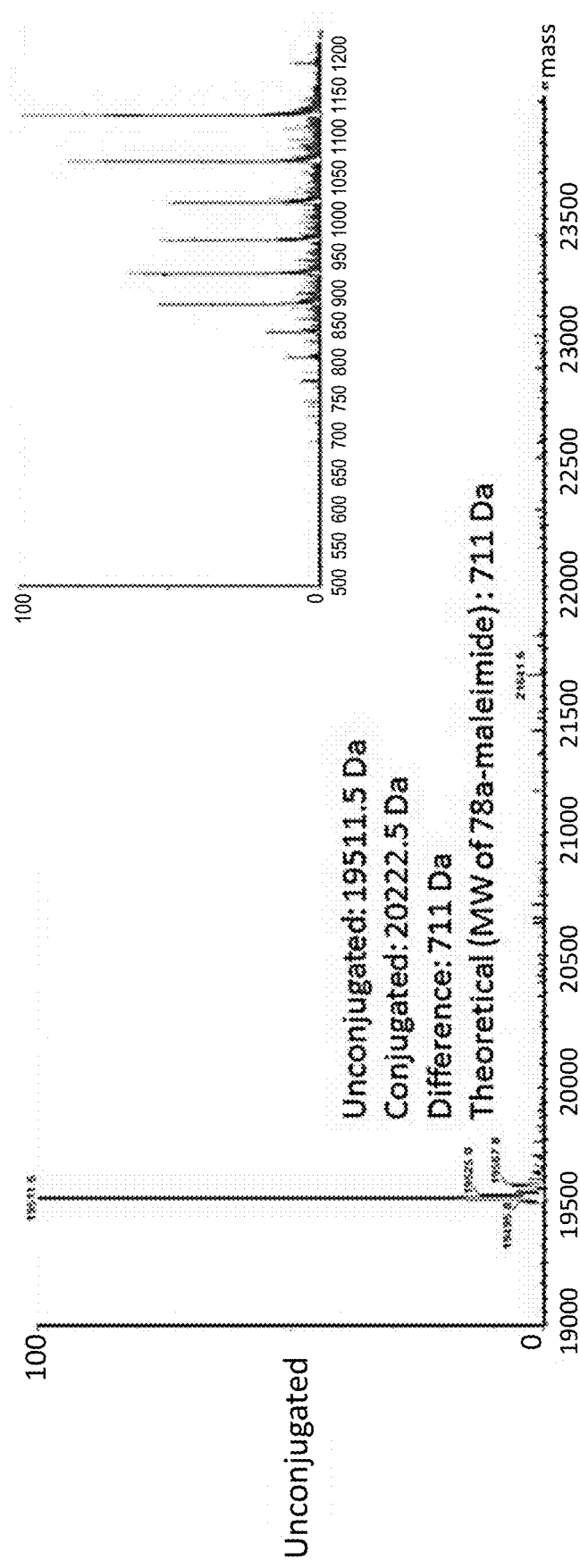
Figure 60B:
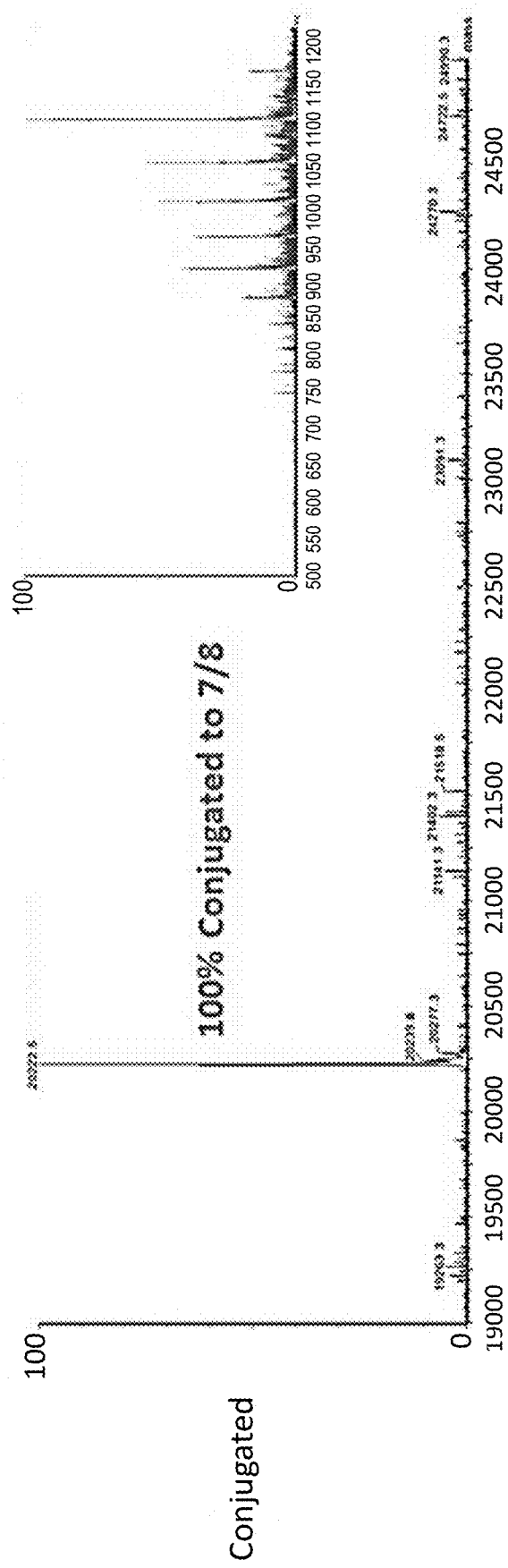

A gL/gH nanoparticle (SEQ ID NO: 419) was reduced using 2 mM TCEP and then oxidized via the addition of 1×PBS and using a 100 kD microspin column to remove TCEP. SM7/8a was then incubated with the gL/gH nanoparticle for conjugation. Excess SM7/8a was removed from the reaction via a 100 kD microspin column. Mass spectrometry (MS) data indicated that about 100% of the polypeptide comprising single-chain gL/gH and ferritin (SEQ ID NO: 419) was conjugated to SM7/8a (FIG. 60B) based on shift of the main MS peak relative to the spectrum of the unconjugated polypeptide (FIG. 60A). The difference between the mass of the conjugated and unconjugated polypeptide corresponds to the molecular weight of the SM7/8a-linker-maleimide adduct (711 Da).

Figure 61A:
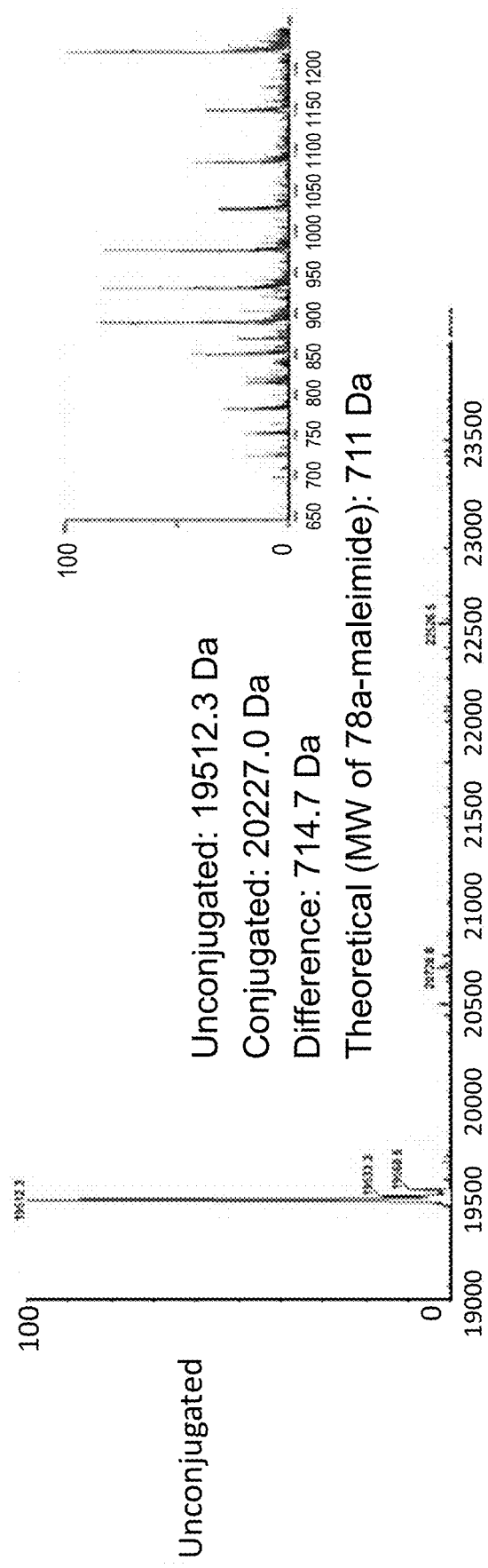
Figure 61B:
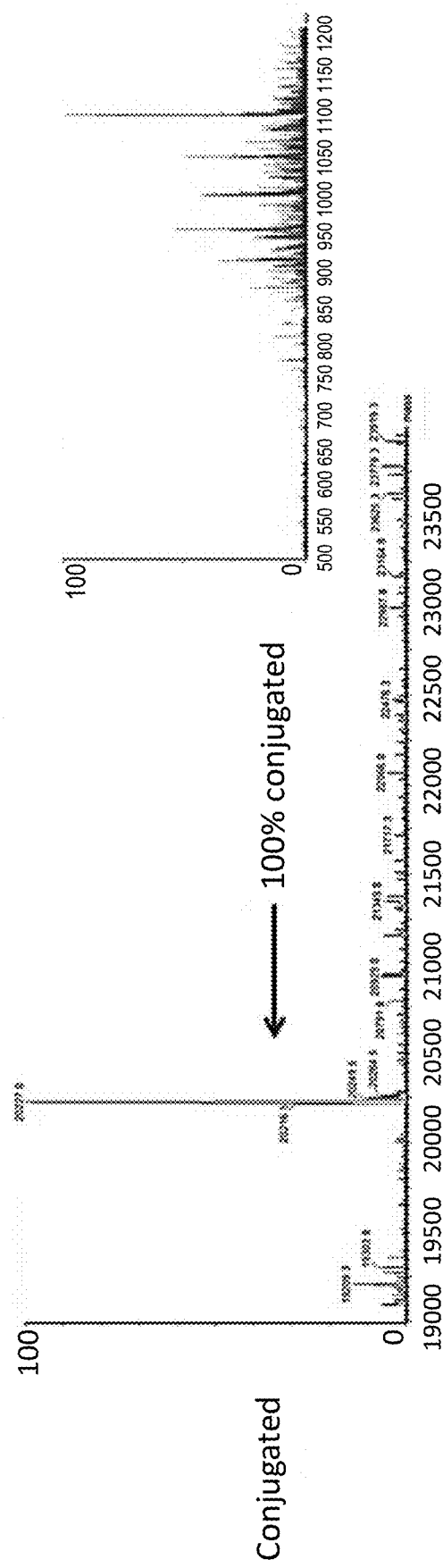

A gp220 nanoparticle (SEQ ID NO: 401) was reduced using 2 mM TCEP and then oxidized via the addition of 1×PBS and using a 100 kD microspin column to remove TCEP. The SM7/8a was then incubated with the gL/gH nanoparticle for conjugation. Excess SM7/8a was removed from the reaction via a 100 kD microspin column. MS data indicated that about 100% of a conjugated polypeptide comprising gp220 and ferritin (SEQ ID NO: 401) is conjugated to SM7/8a (FIG. 61B) based on shift of the main MS peak relative to the spectrum of the unconjugated polypeptide (FIG. 61A).

Figures 62A, 62B, 62C, 62D:
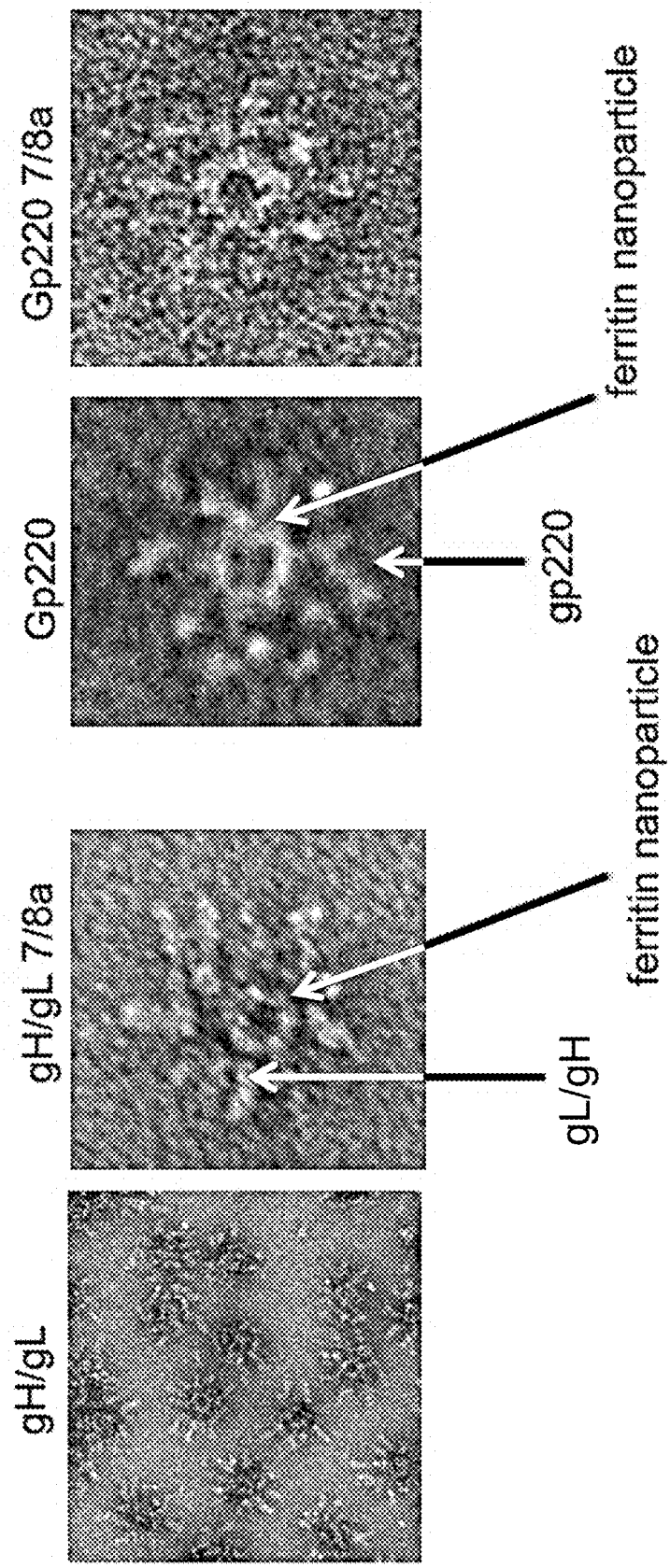

Electron microscopy (EM) data also confirmed that conjugation of SM7/8a to polypeptides comprising single-chain gL/gH and ferritin (FIG. 62B in comparison to unconjugated sample in FIG. 62A) or comprising gp220 and ferritin (FIG. 62D in comparison to unconjugated sample in FIG. 62C) did not disrupt nanoparticle assembly.

Figure 63A:
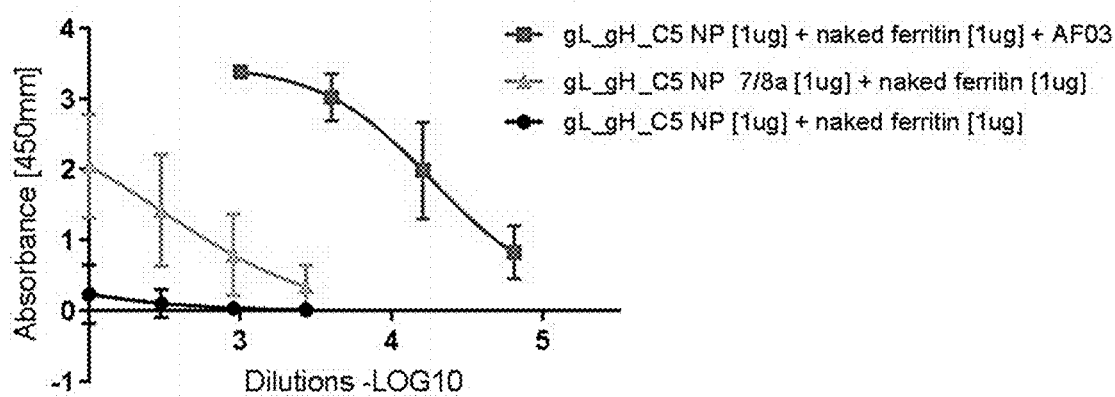
Figure 63B:
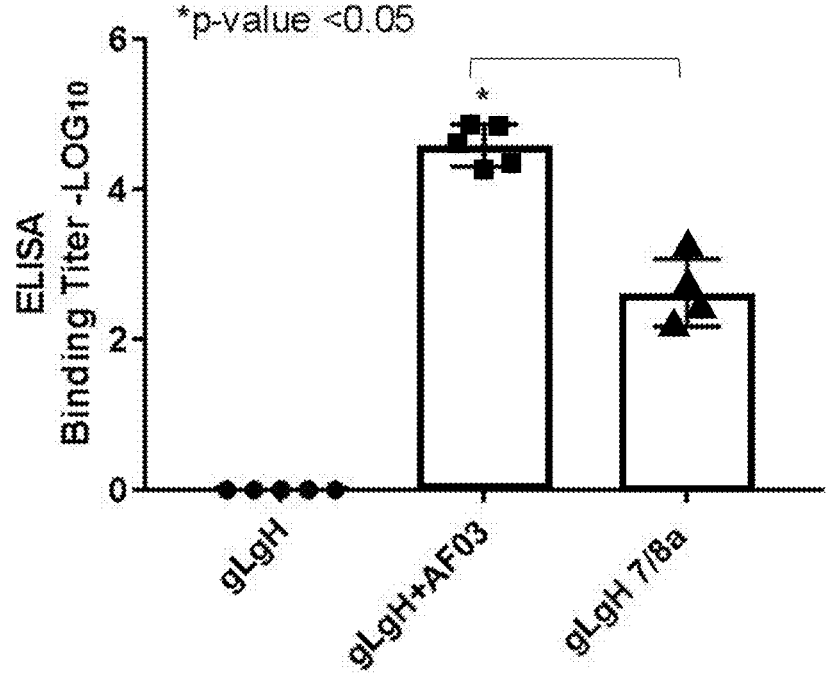
Figure 64A:
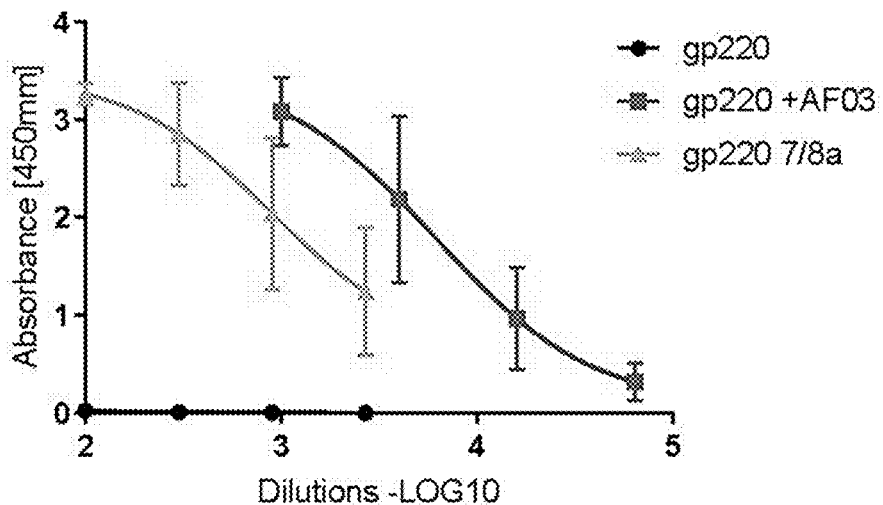
Figure 64B:
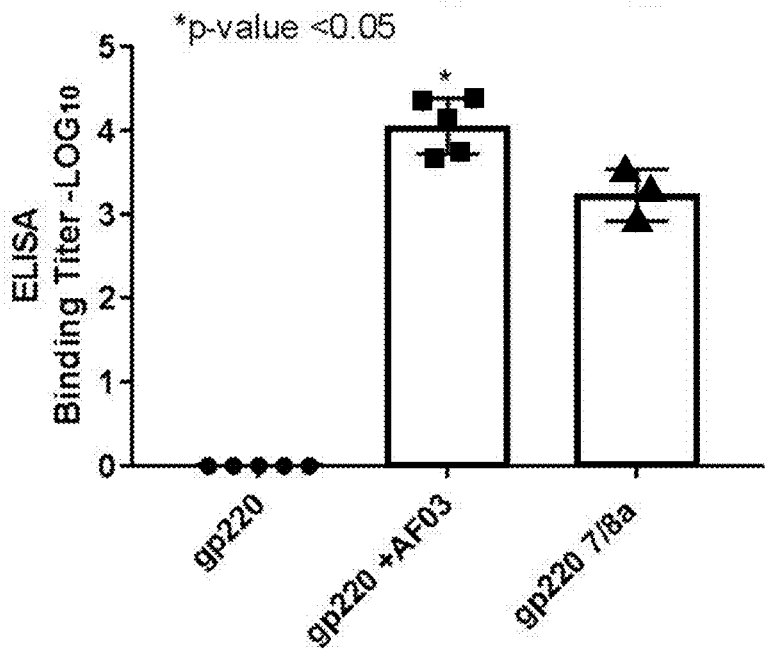
Figure 65A:
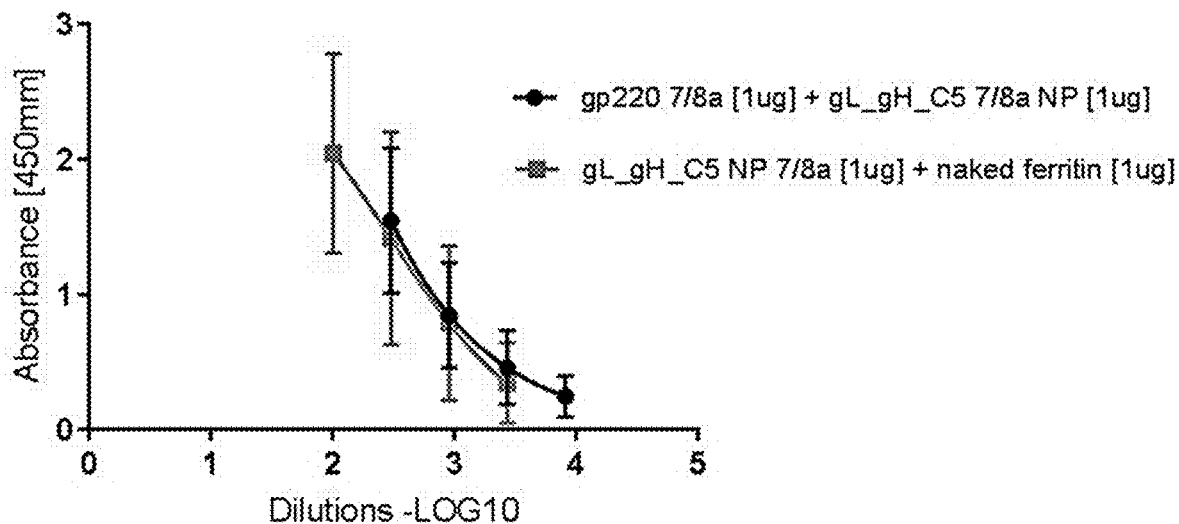
Figure 65B:
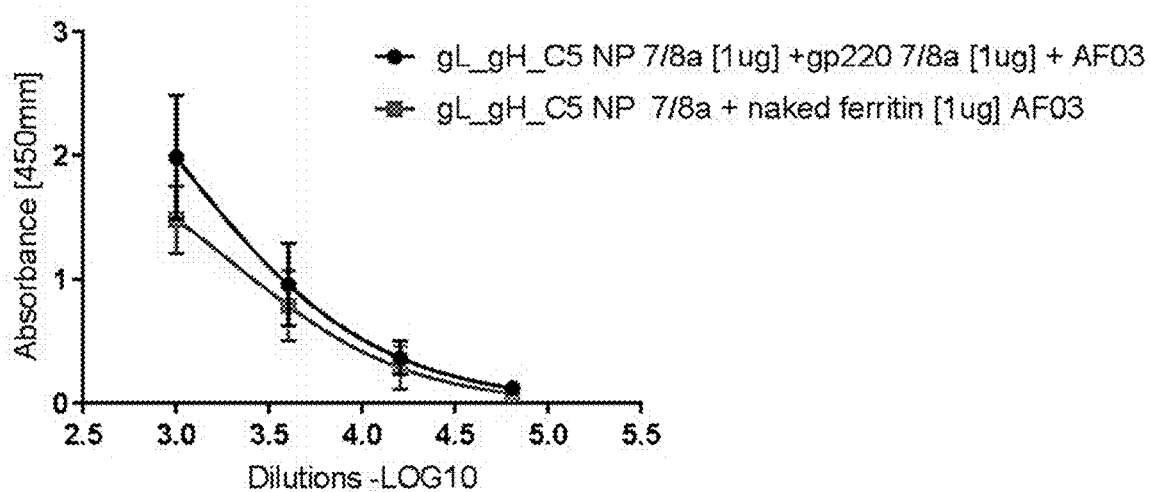
Figure 66A:
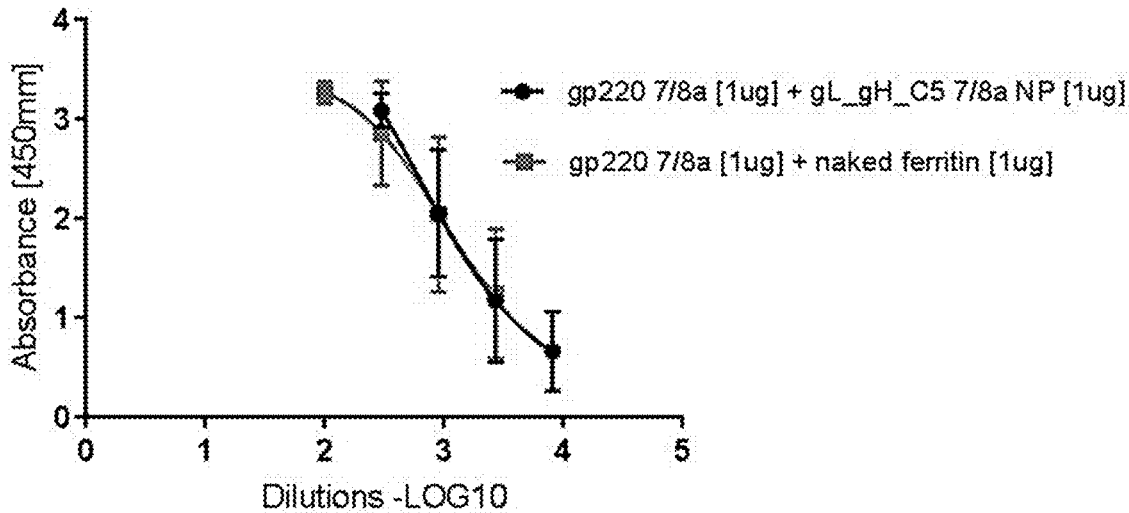
Figure 66B:
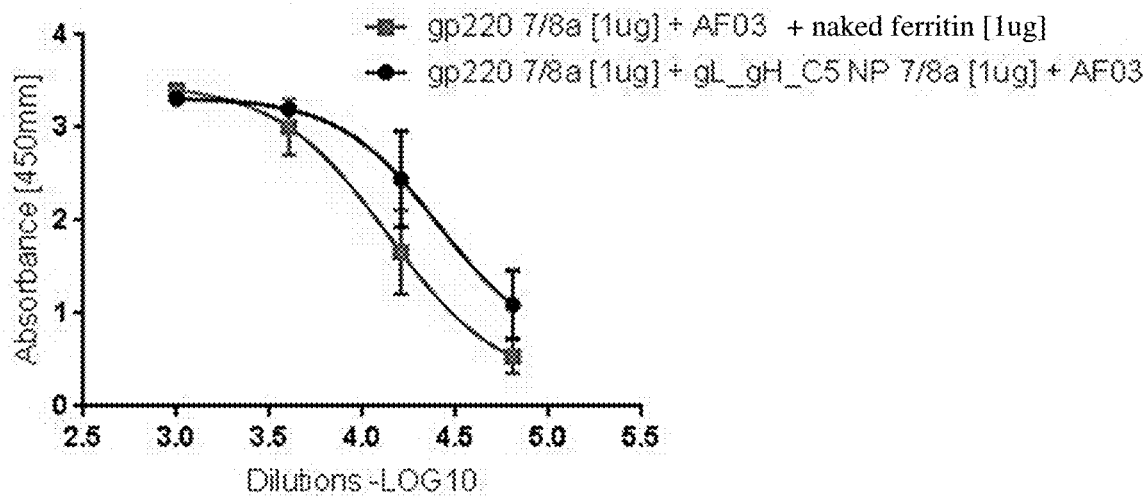

Antibody responses were assayed by ELISA following immunization with 1 µg of nanoparticles comprising single-chain gL/gH (gL_gH_C5 NP, FIGS. 63A and 63B) or nanoparticles comprising gp220 (FIGS. 64A and 64B). Nanoparticles were in combination with 1 µg of naked ferritin and were unconjugated or conjugated to SM7/8a.

Unconjugated nanoparticles were administered with or without admixed AF03 adjuvant. Each mouse received 100 µL of the nanoparticle composition as described above. For mice receiving AF03 adjuvant, a 1:1 volume of AF03 was mixed with the nanoparticles. BALB/c mice (n=5/group) were immunized twice with a 3-week interval between doses. A bleed was taken for ELISA analysis at week 5. The most robust ELISA responses were seen for nanoparticles administered in the AF03 adjuvant. Conjugation to SM7/8a produced a more robust ELISA response compared to unconjugated nanoparticles without adjuvant.

The effect of coadministration of 1 µg each of gL_gH_C5 nanoparticles conjugated to SM7/8a and gp220 nanoparticles conjugated to SM7/8a was also assessed, as compared to single administration of either nanoparticle accompanied by naked ferritin nanoparticles in FIGS. 65A-65B and 66A-66B. No interference was observed on the immune response to either single-chain gL/gH (FIGS. 65A-65B, without and with AF03, respectively) or gp220 (FIGS. 66A-66B, without and with AF03, respectively).

Example 17: Long-Term Immunogenicity Studies

Studies were performed to assess immunogenicity at 3 months after dosing with nanoparticles comprising single-chain gL/gH (gL/gH_C5, SEQ ID NO: 419). BALB/c mice (n=5/group) were immunized twice with a 3-week interval between doses. Naked ferritin (i.e., ferritin not conjugated to any polypeptide or adjuvant) was administered at 1 µg with the 1 µg nanoparticles comprising single-chain gL/gH, and the nanoparticles were formulated in the presence or absence of admixed AF03 adjuvant. A bleed was taken for ELISA analysis at week 13. For mice receiving AF03 adjuvant, a 1:1 volume of AF03 was mixed with the nanoparticle composition. Each mouse received 100 µL of the nanoparticle composition described above. Some mice received nanoparticles comprising single-chain gL/gH in which the ferritin was conjugated to SM7/8a ("7/8a" in FIGS. 67-68).

Figure 67:
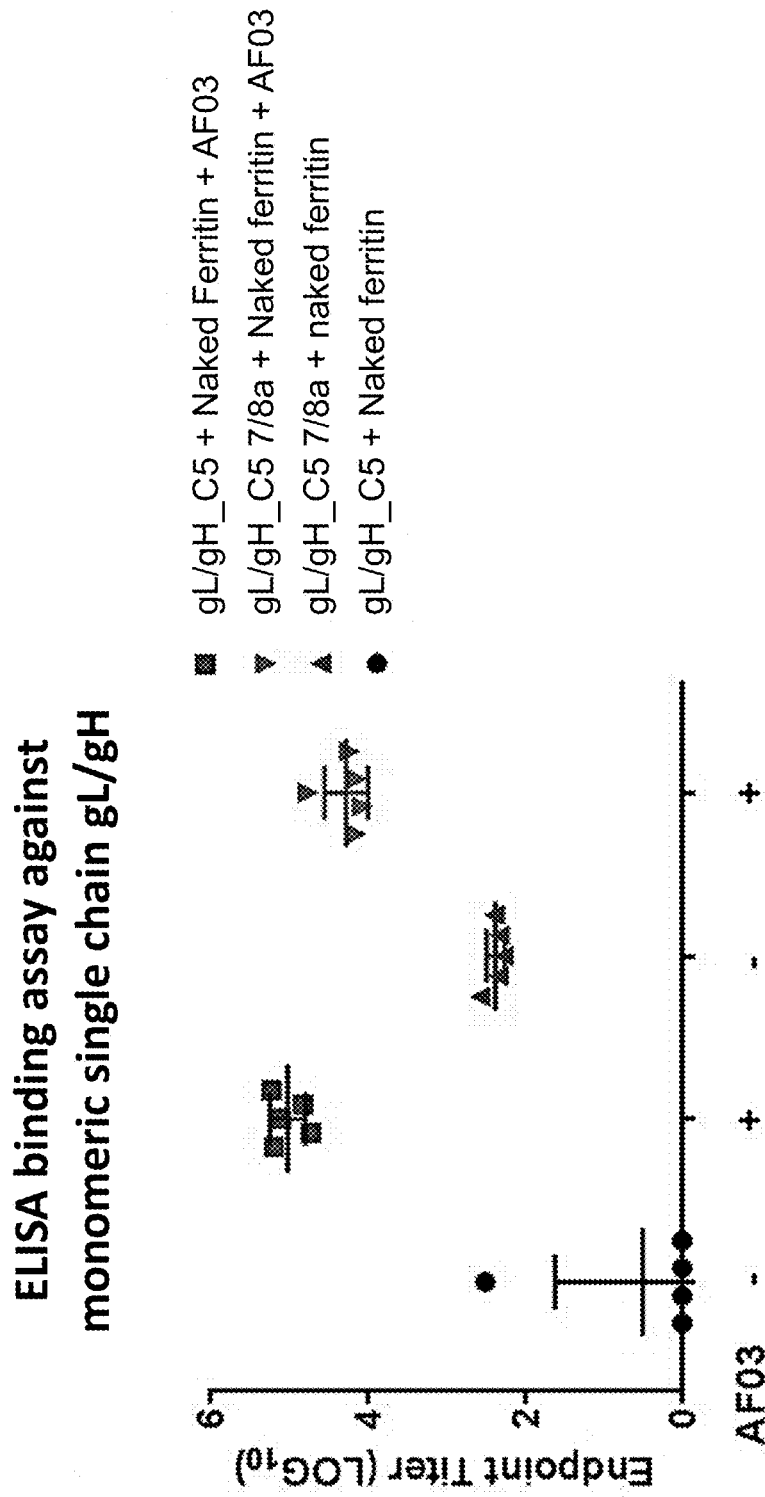

As shown in FIG. 67, nanoparticles comprising single-chain gL/gH conjugated to SM7/8a produced the greatest immune response when formulated in AF03. A robust immune response was also seen for these nanoparticles without AF03.

Figure 68:
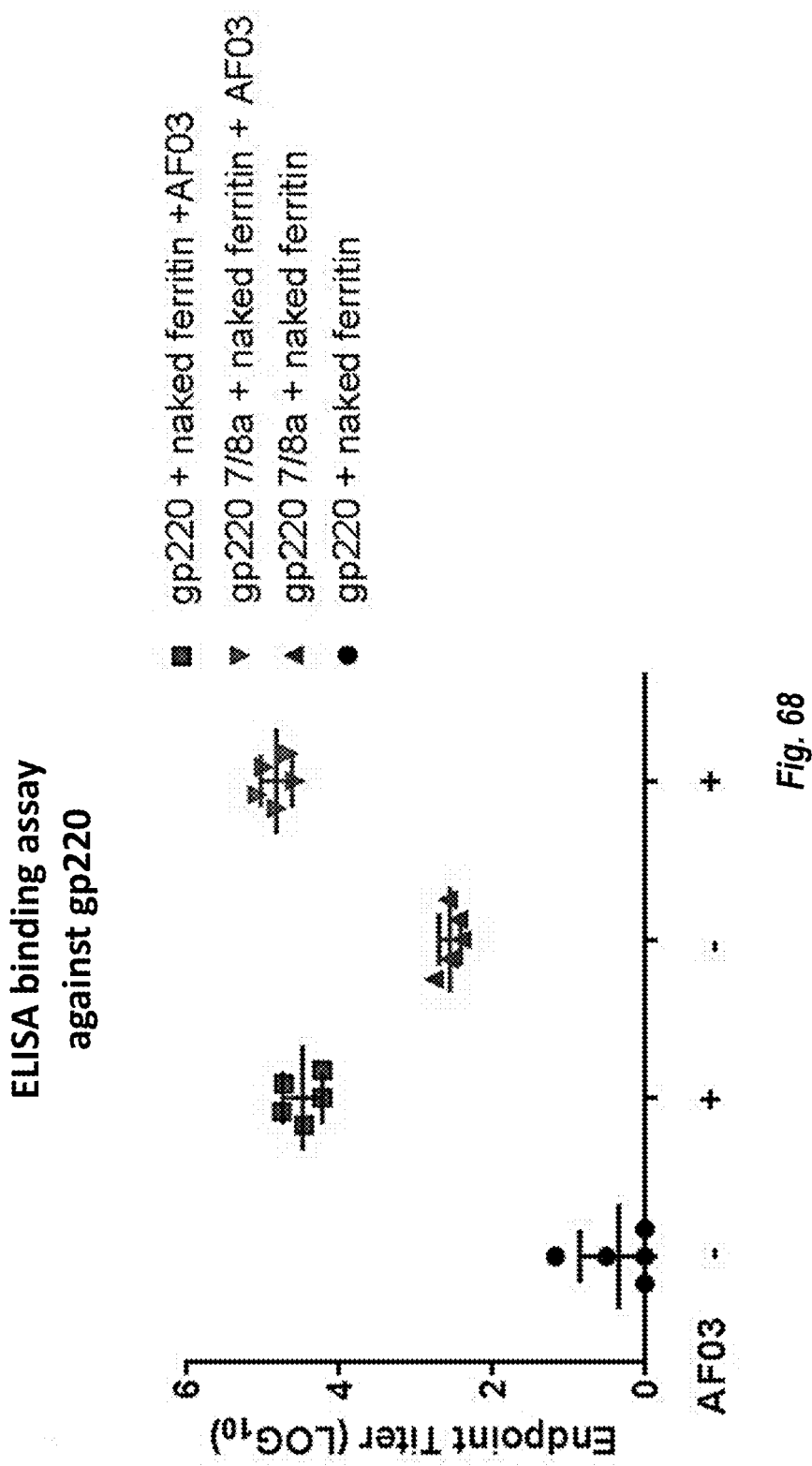

A parallel experiment was performed using gp220 nanoparticles (SEQ ID NO: 401) (with or without conjugation to SM7/8a) in place of the nanoparticles comprising single-chain gL/gH. Similar results were seen for these nanoparticles, wherein the formulation including admixed AF03 produced the most robust response, and a robust immune response was also seen for these nanoparticles without AF03 (FIG. 68).

Figure 69:
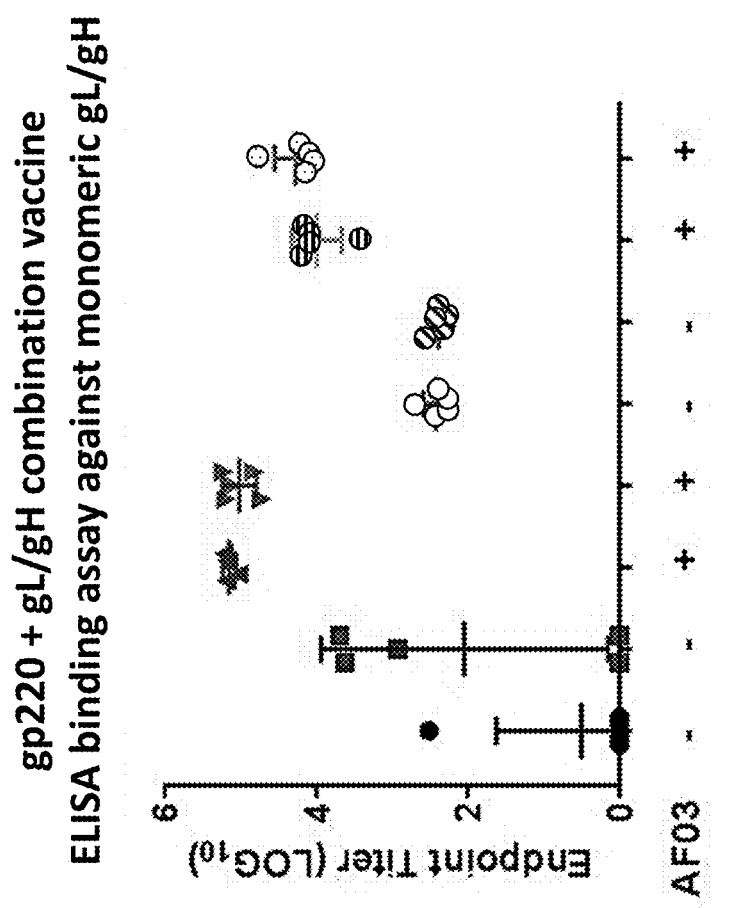
Figure 70:
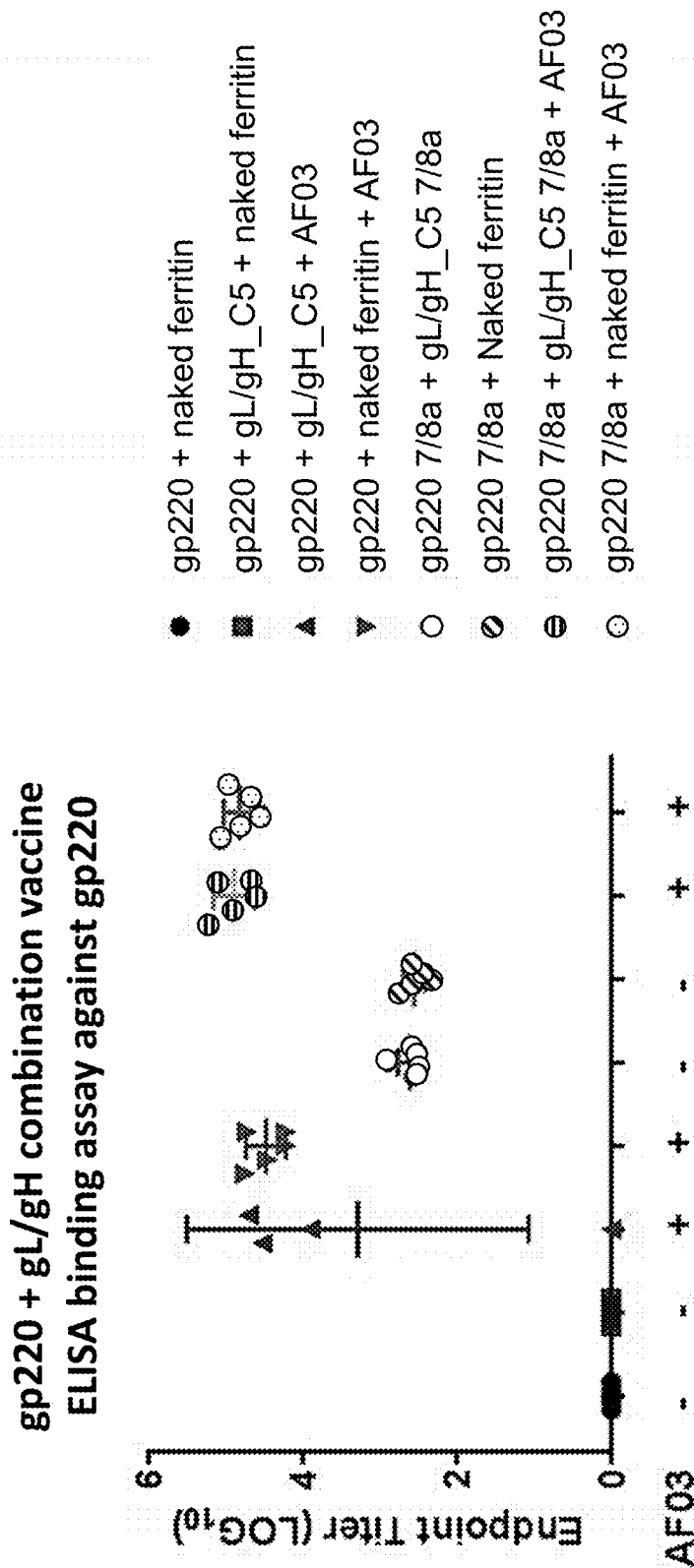

The immune response elicited by a bivalent composition comprising nanoparticles comprising single-chain gL/gH (gL/gH_C5; SEQ ID NO: 419) and nanoparticles comprising gp220 (SEQ ID NO: 401) was assessed. BALB/c mice (n=5/group) were immunized with a 3-week interval between doses. 100 µL of the nanoparticle composition containing 1 µg of each nanoparticle was administered. For mice receiving AF03 adjuvant, a 1:1 volume of AF03 was mixed with vaccine. A terminal week 13 bleed was taken for ELISA analysis. For immune responses against both single-chain gL/gH (FIG. 69) and gp220 (FIG. 70), no interference was seen due to administration of the nanoparticles in combination, as compared to administration of either nanoparticle in combination with naked ferritin.

Figure 72:
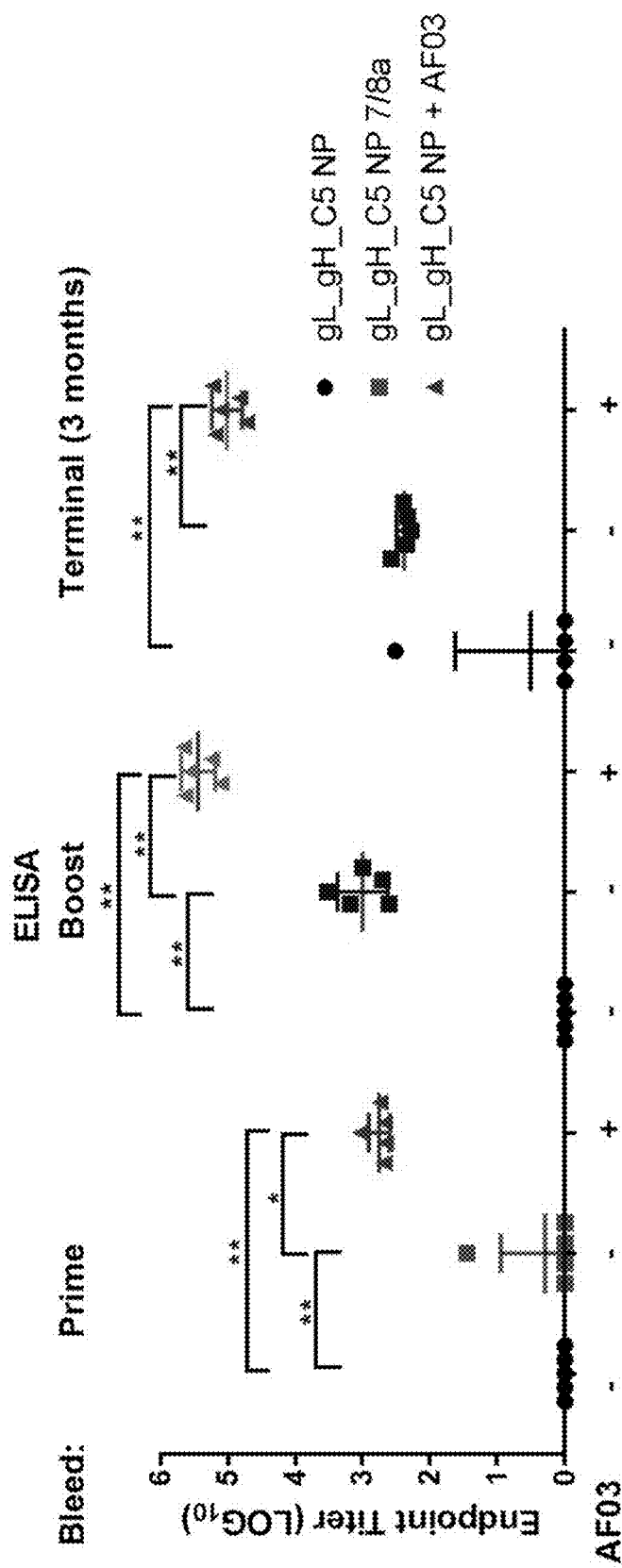
Figure 73:
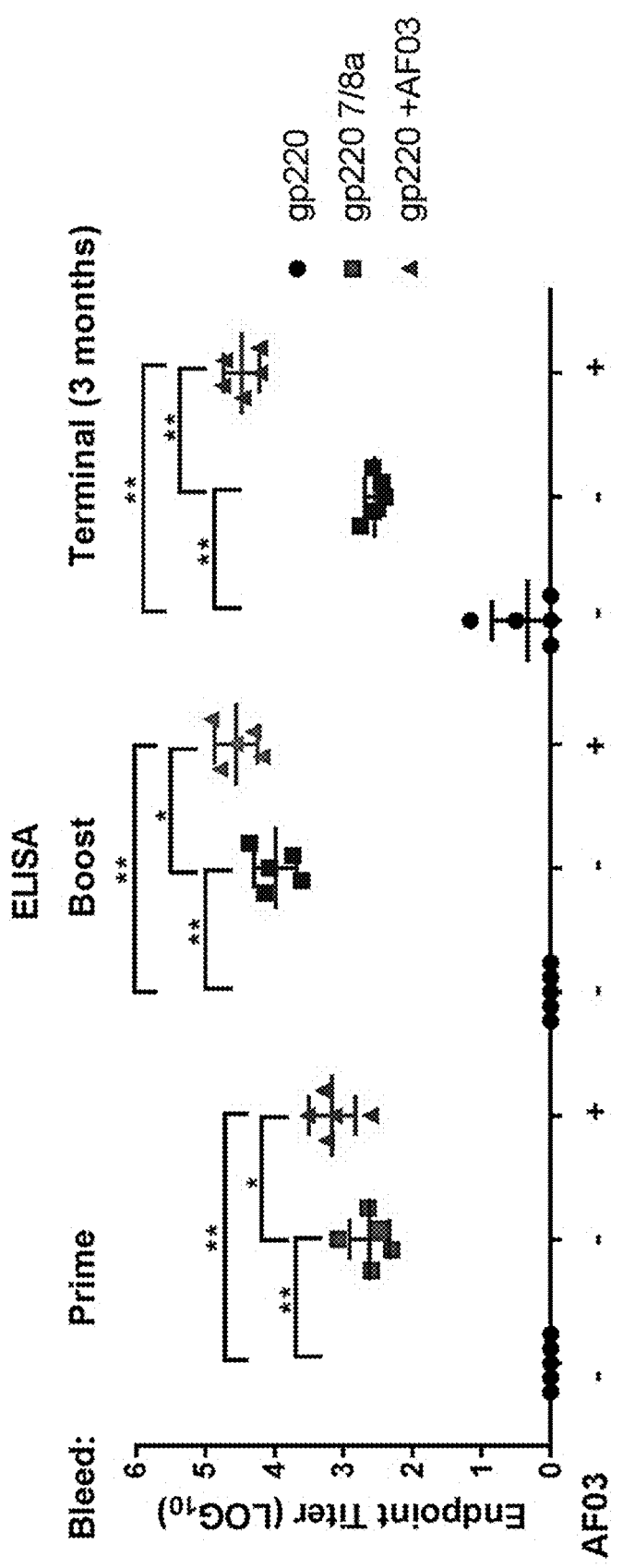

Further experiments with the gL/gH_C5 nanoparticle (SEQ ID NO: 419) confirmed that long-term immune responses were seen when the nanoparticle was conjugated to SM7/8a (7/8a) or when the nanoparticle was formulated in AF03 (FIG. 72). BALB/c mice (n=5/group) were immunized with a 3-week interval between doses. 100 µL of the nanoparticle composition containing 1 µg of nanoparticles was administered. For mice receiving AF03 adjuvant, a 1:1 volume of AF03 was mixed with vaccine. Week 2 (Prime), 5 (Boost), and 13 (Terminal) bleeds were taken for ELISA analysis. A parallel experiment was performed using gp220 nanoparticles (SEQ ID NO: 401) and a similar long-term response was also seen for gp220 nanoparticles (FIG. 73).

A different nanoparticle comprising single-chain gL/gH (gL_gH_C7: SEQ ID NO: 420) was also assessed. The gL_gH_C7 construct comprises a flexible linker between the gH polypeptide and the ferritin with a cysteine as a conjugation site for an immune-stimulatory moiety. The linker may be used with a ferritin lacking a surface-exposed cysteine (as shown in SEQ ID NO: 420). SM7/8a was conjugated to gL_gH_C7 by reducing the protein using 2 mM TCEP and then oxidizing by adding 1× PBS and using a 100 kD microspin column to remove TCEP. The SM7/8a was then incubated with the gL/gH nanoparticle. Following conjugation, excess SM7/8a was removed from the reaction via a 100 kD microspin column.

Figure 71A:
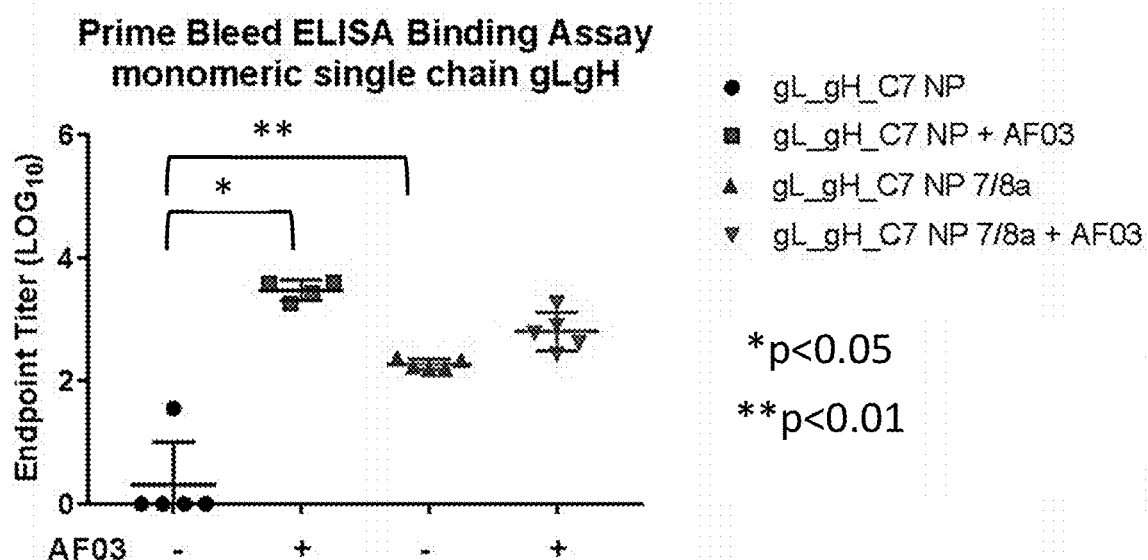
Figure 71B:
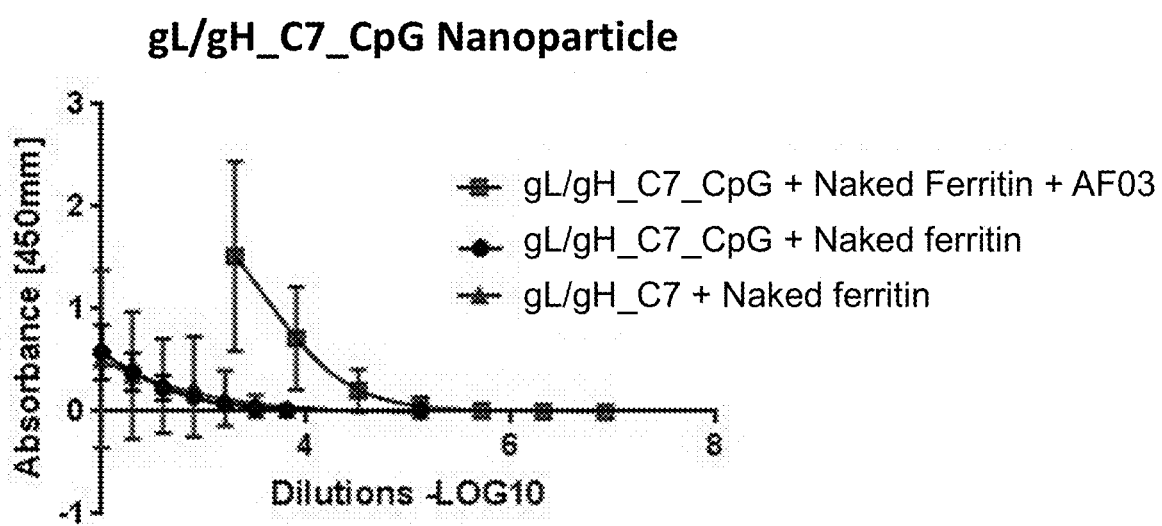
Figure 71C:
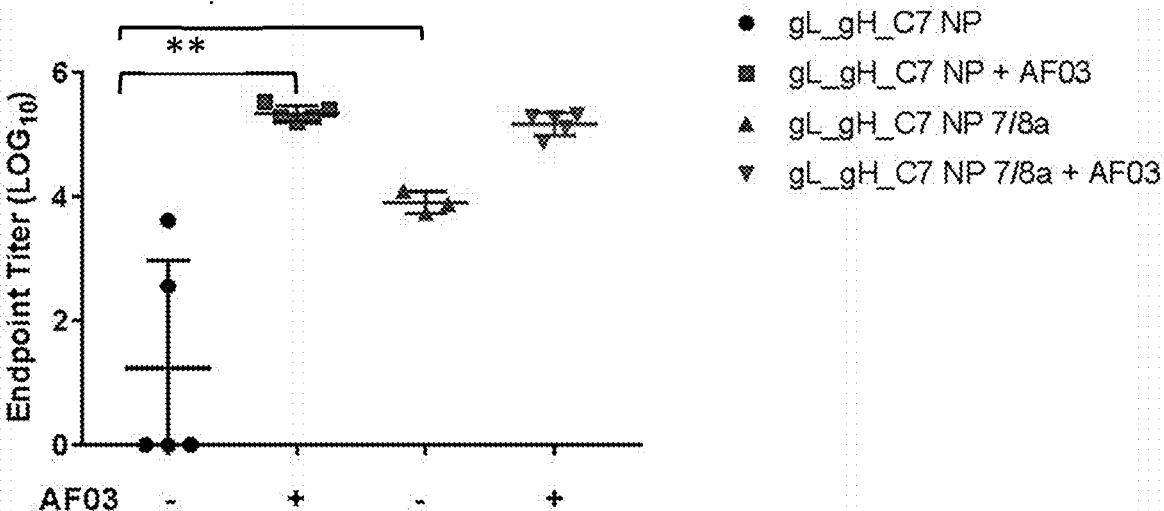
Figure 71D:
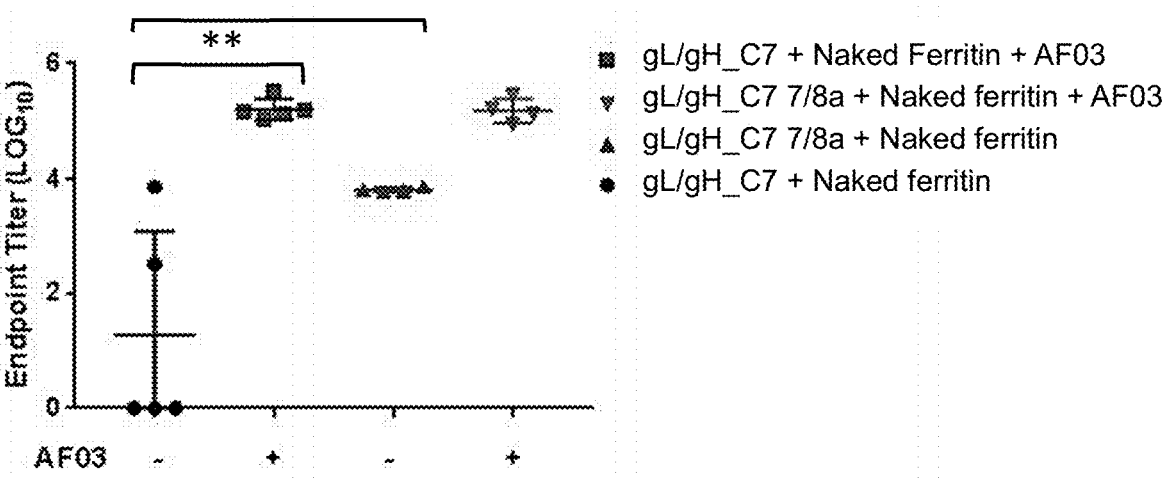

Mice received 1 µg of these gL/gH nanoparticles, either conjugated to 7/8a or unconjugated, plus 1 µg of naked ferritin. 100 µL of the nanoparticle composition containing 1 µg of nanoparticles was administered. BALB/c mice (n=5/group) were immunized with a 3-week interval between doses. For mice receiving AF03 adjuvant, a 1:1 volume of AF03 was mixed with the nanoparticle composition. Week 2 (prime), 5 (booster), and 13 (terminal) bleeds were taken for ELISA analysis. These nanoparticles elicited immune responses when formulated in AF03 or when conjugated to SM7/8a as measured by ELISA endpoint titer at prime bleed (FIG. 71A). Similar results were seen with booster bleed (FIG. 67C) or terminal bleed (FIG. 71D) samples. These nanoparticles were also conjugated to a CpG oligodeoxynucleotide, and administered in the same way. Results for the CpG conjugate were similar to unconjugated nanoparticles (FIG. 71B) at week 5.

Example 18: Characterization of Nanoparticles Comprising *Trichoplusia ni* Ferritin Nanoparticles were also developed comprising *Trichoplusia ni* ferritin and gp220 and/or gL/gH polypeptides. *Trichoplusia ni* ferritin nanoparticles contain heavy and light chains self-assembled at a 1:1 ratio. It was found that combining one non-ferritin polypeptide with the light chain and another non-ferritin polypeptide on the heavy chain allowed presentation of two distinct polypeptides on the surface of individual nanoparticles. Thus, for example, a self-assembled *Trichoplusia ni* ferritin nanoparticle could present both gp220 and gL/gH.

Figure 74A:
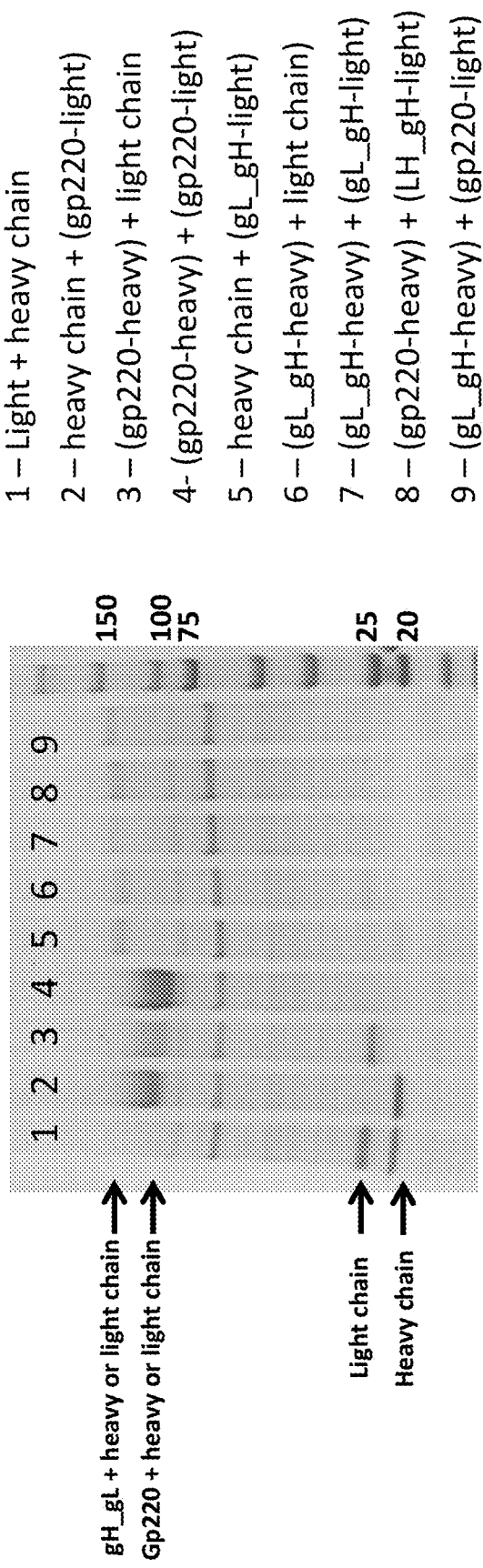
Figure 74B:
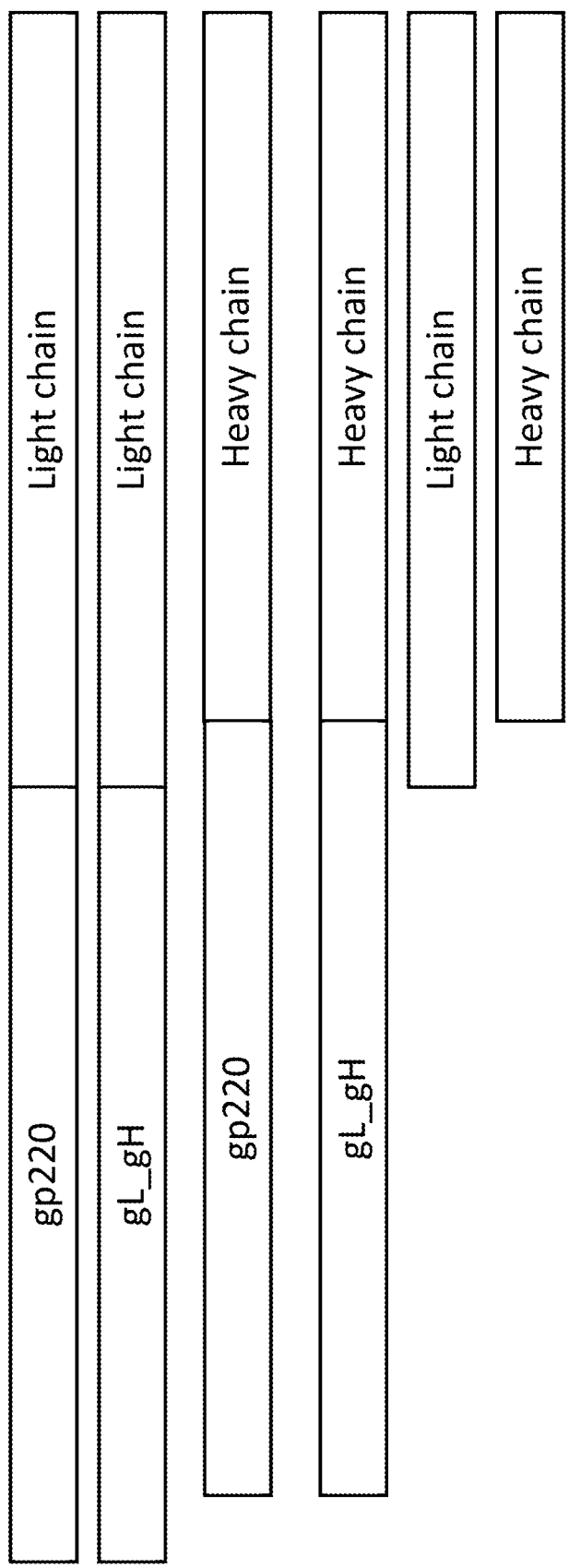

A *Trichoplusia ni* ferritin nanoparticle was produced and purified with the heavy chain fused to either gp220 (SEQ ID NO: 424) or single-chain gL/gH (SEQ ID NO: 425) and the light chain fused to either gp220 (SEQ ID NO: 426) or single-chain gL/gH (SEQ ID NO: 427) (constructs illustrated in FIG. 74B and visualized by Coomassie gel staining in FIG. 74A, showing the expected increase in molecular weight relative to light and heavy chains alone). The combination of a light chain and a heavy chain fused to gL/gH and gp220, respectively or vice versa, generated an individual multivalent nanoparticle that can present two different EBV polypeptides.

Figure 75A:
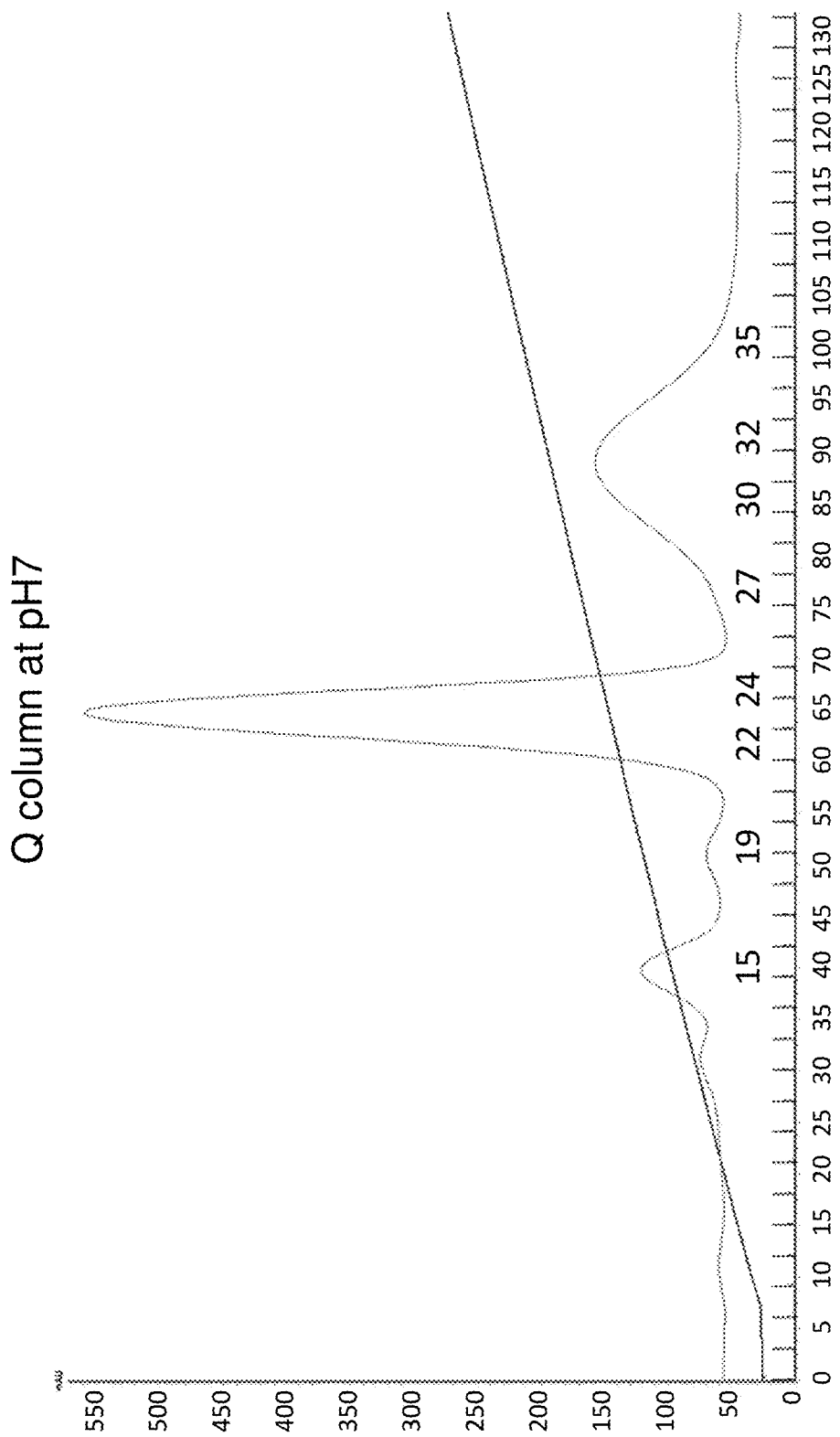
Figure 75B:
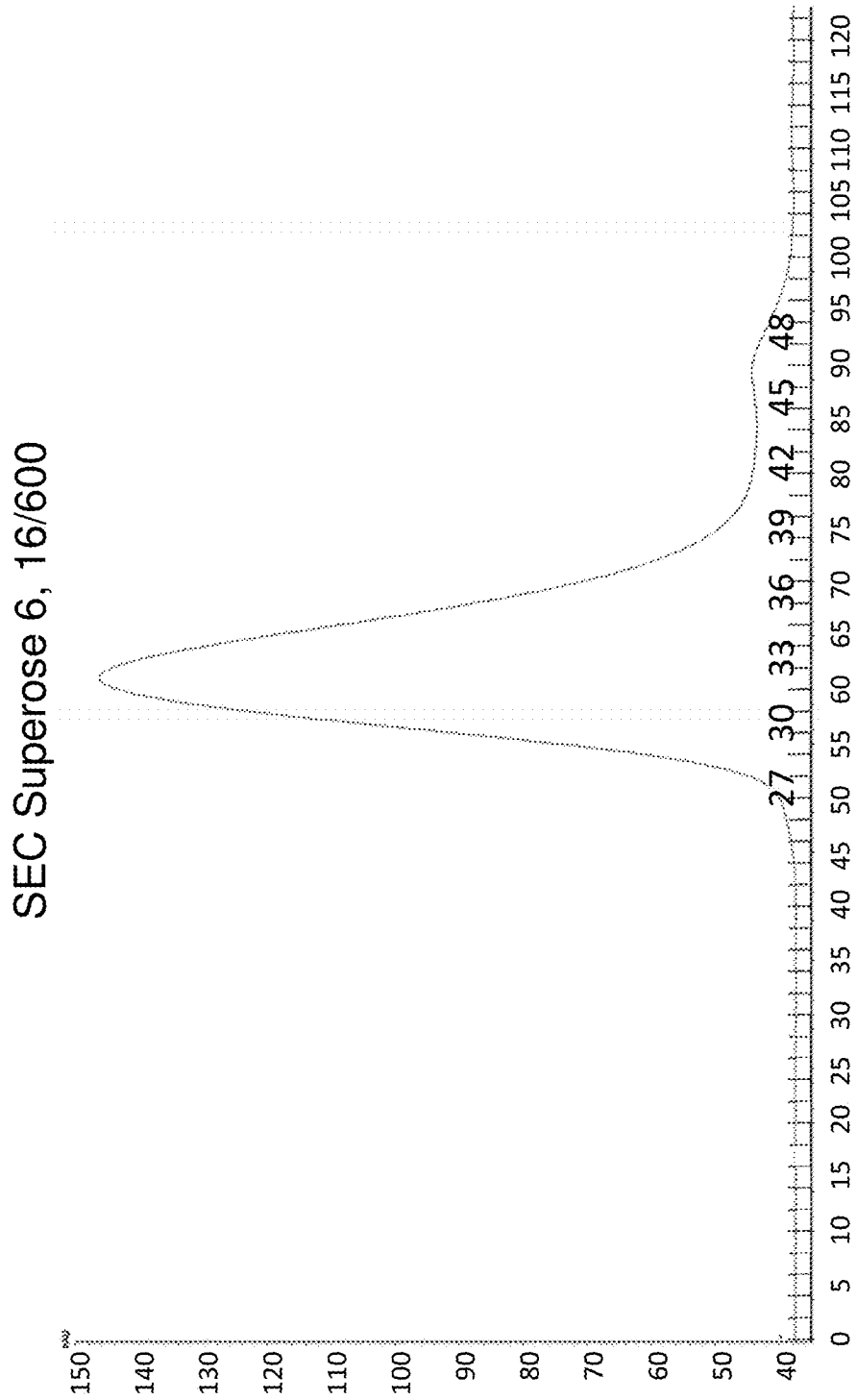
Figure 76A:
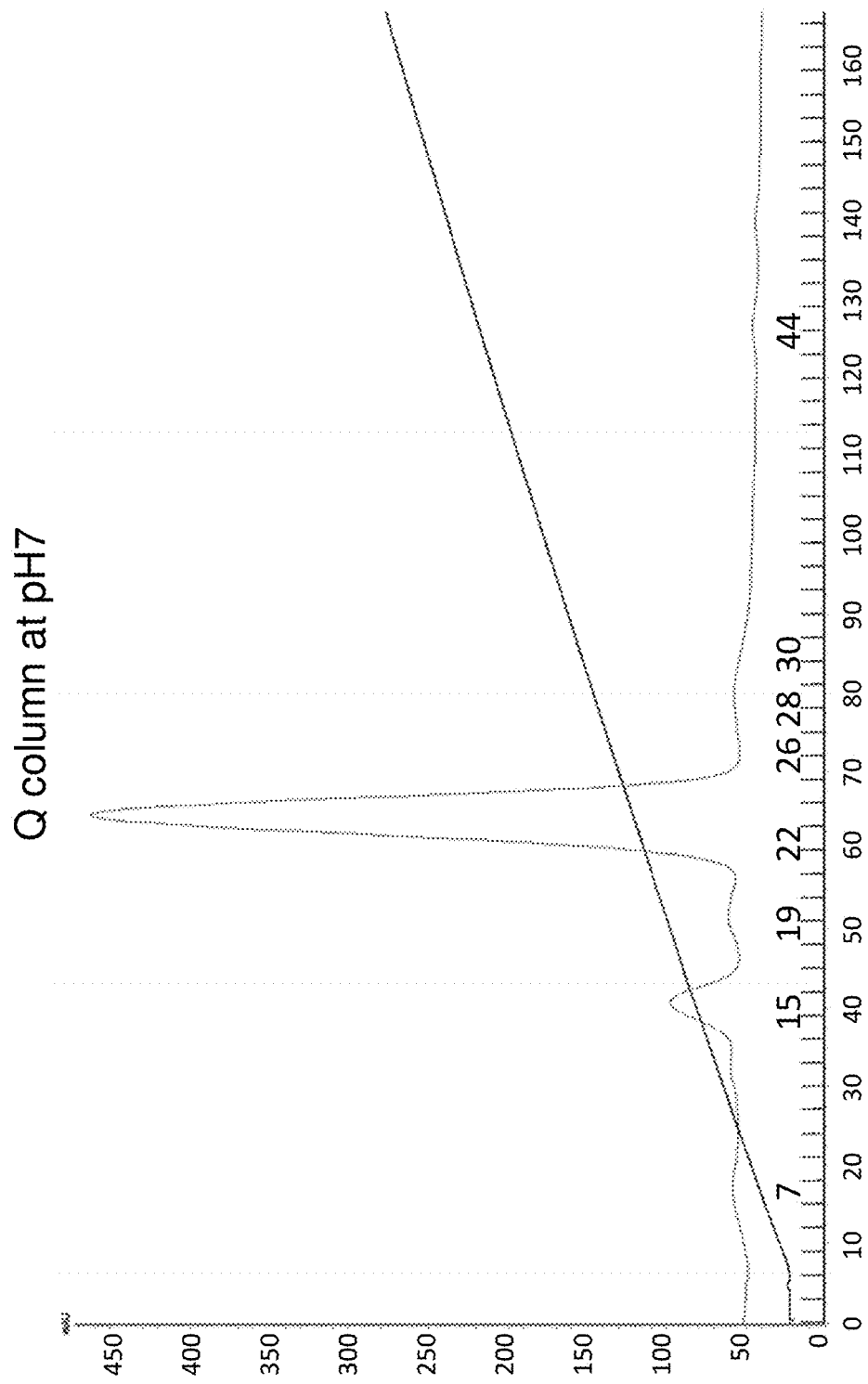
Figure 76B:
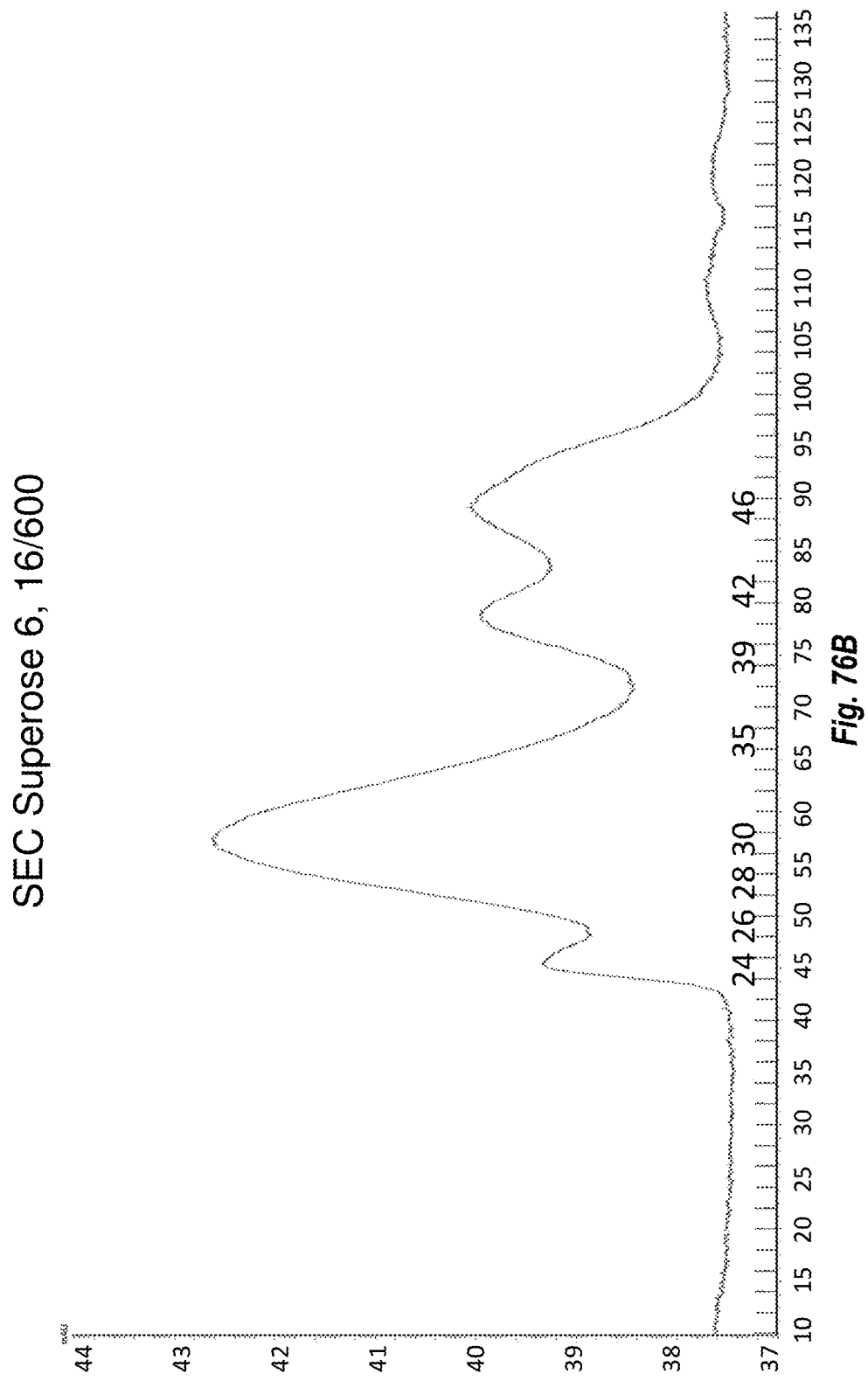

Two *T. ni* ferritin nanoparticles with either only gp220 in both the heavy and light chains (as shown in FIG. 75E) or gp220 in the heavy chain and gH_gL in the light chain (as shown in FIG. 76E) were also produced. The purification followed two steps: The first purification step was an ion exchange chromatographic step (Q column, see FIG. 75A with Coomassie results in FIG. 75C and FIG. 76A with Coomassie results shown in FIG. 76C). This step was followed by size exclusion chromatography (see FIG. 75B with Coomassie results in FIGS. 75D and 76B with Coomassie results in FIG. 76D).

Figure 77D:
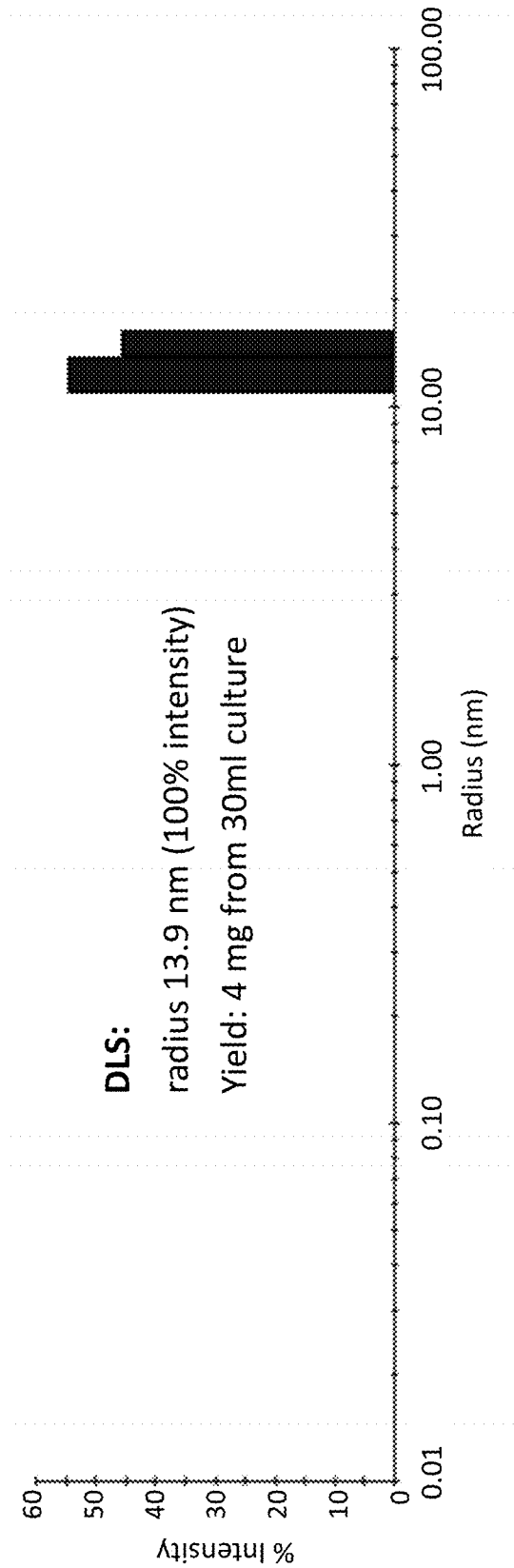
Figure 77H:
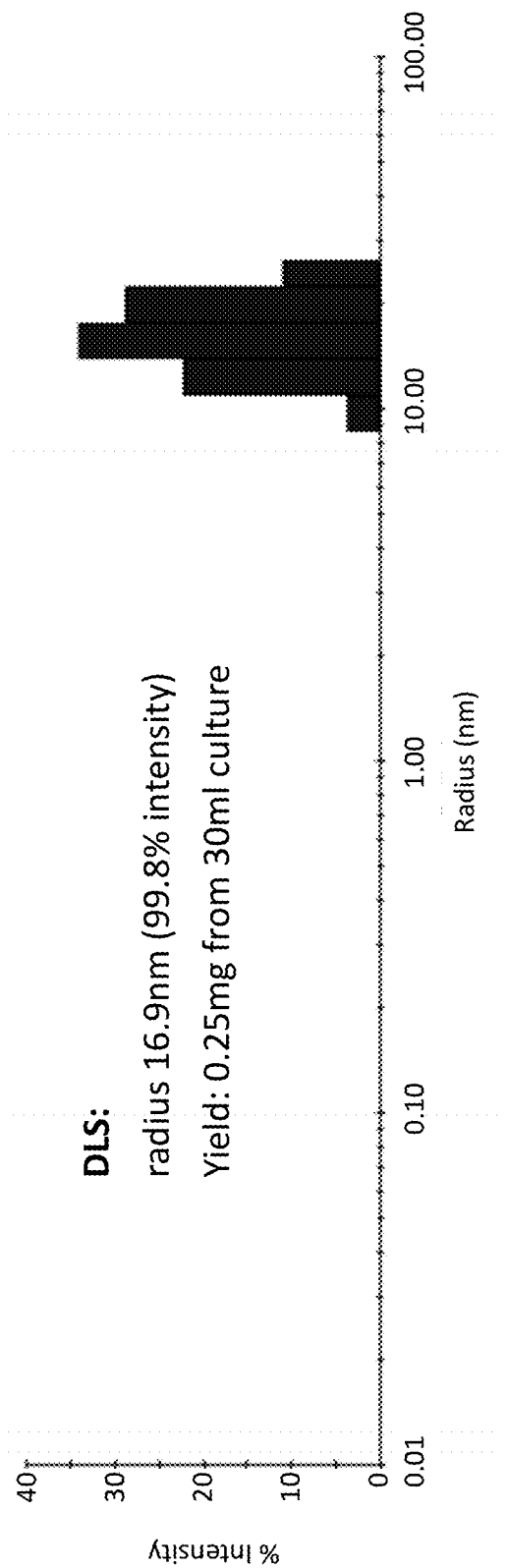
Figure 78B:
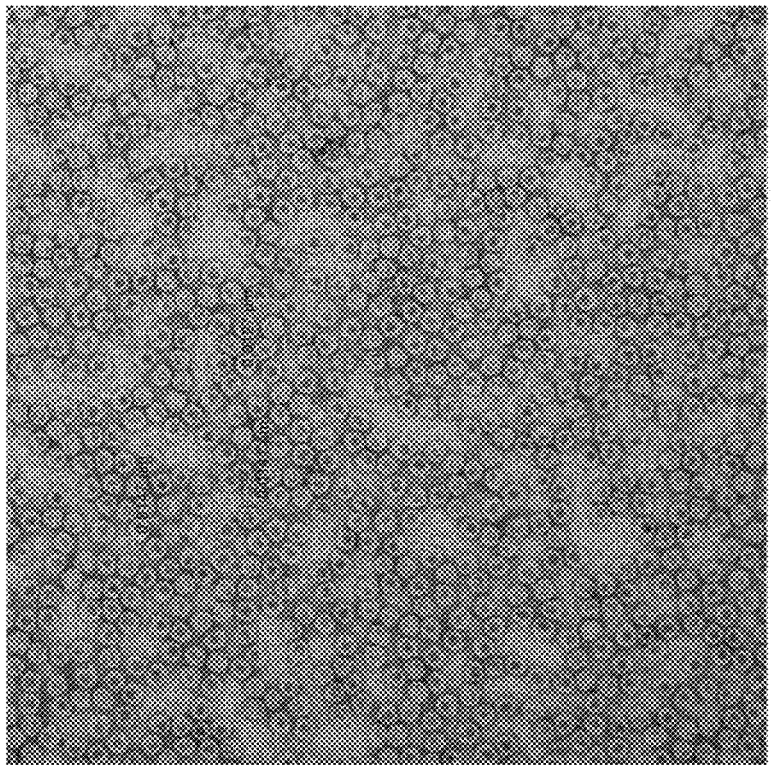
Figure 78A:
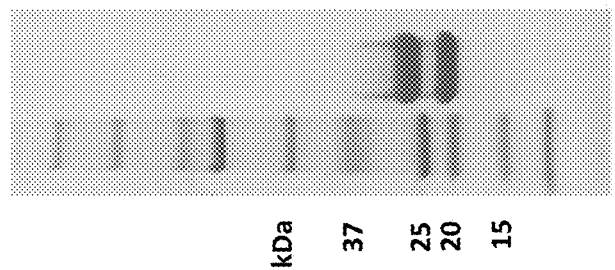
Figure 78C:
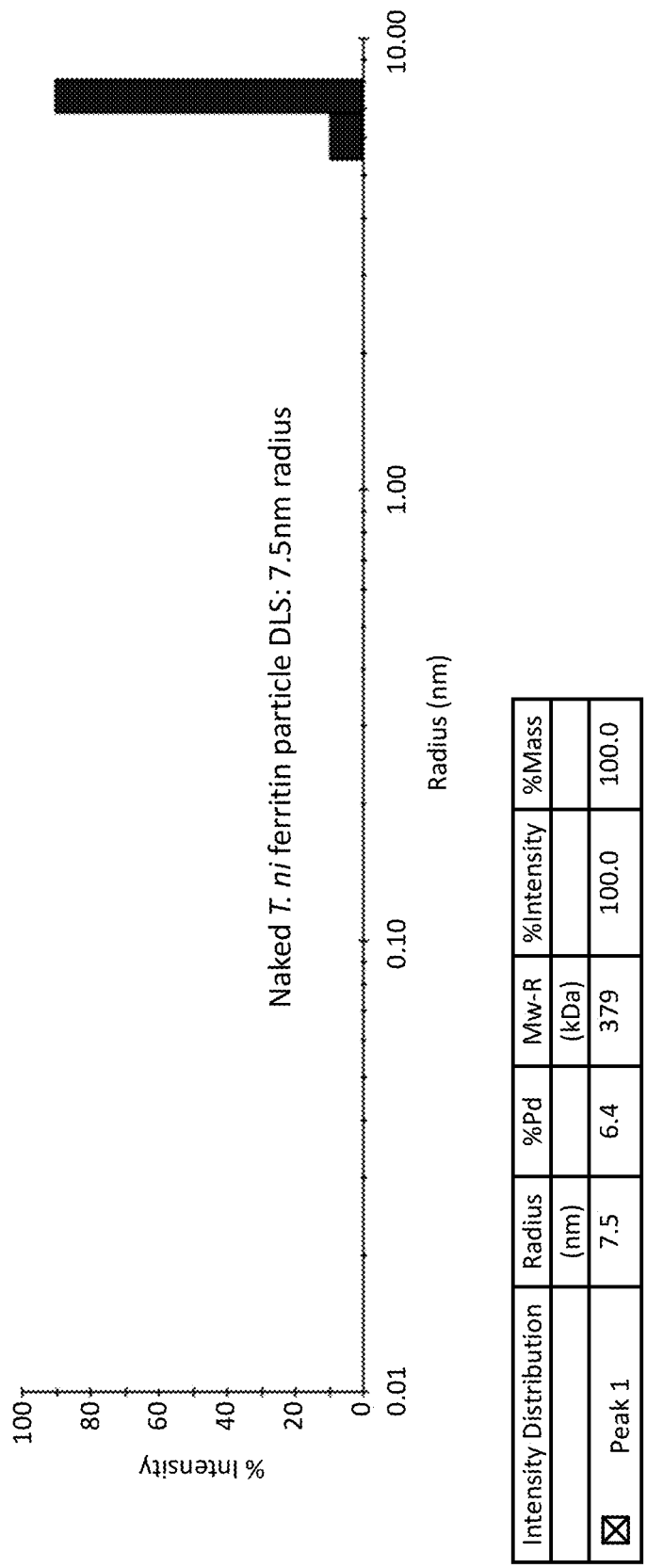

Nanoparticles comprising *Trichoplusia ni* light and heavy chain fused to gp220 (SEQ ID NOs: 424 and 426; illustrated in FIG. 77B) showed a profile consistent with formation of a nanoparticle comprising the heterologous gp220 polypeptide, based on Coomassie staining (FIG. 77A), an increase in DLS radius (FIG. 77D) relative to naked *T. ni* ferritin (FIG. 78C), and EM analysis (FIG. 77C) in which additional peripheral density around the nanoparticle core appeared relative to the naked nanoparticles (FIG. 77B). Similar results indicative of the presence of heterologous gL/gH and gp220 polypeptides in the nanoparticles were seen for SEQ ID NOs: 424 and 427 (*Trichoplusia ni* light chains with a gL/gH polypeptide and heavy chains with a gp220 polypeptide; see FIGS. 77E-77H for visualization by Coomassie staining, an illustration of the construct, an electron micrograph, and characterization by DLS, respectively). For comparison, FIGS. 78A-78C show Coomassie staining (FIG. 78A), DLS radius (FIG. 78B), and EM analysis (FIG. 78C) for naked *T. ni* ferritin (i.e., not conjugated to any polypeptide).

Thus, use of *T. ni* ferritin allows presentation of 2 polypeptides on individual nanoparticles.

Example 19: gH/gL/gp42 Constructs

A cartoon of a single-chain construct of gH/gL/gp42 fused to ferritin (as in each of SEQ ID NOs: 227-231 and 241-242) is shown in FIG. 86A. The fusion between each protein is via a flexible amino acid linker or a rigid amino acid linker. The single-chain gH/gL/gp42 molecule provides a 1:1:1 ratio of heterotrimer formation on the nanoparticle.

Figure 85:
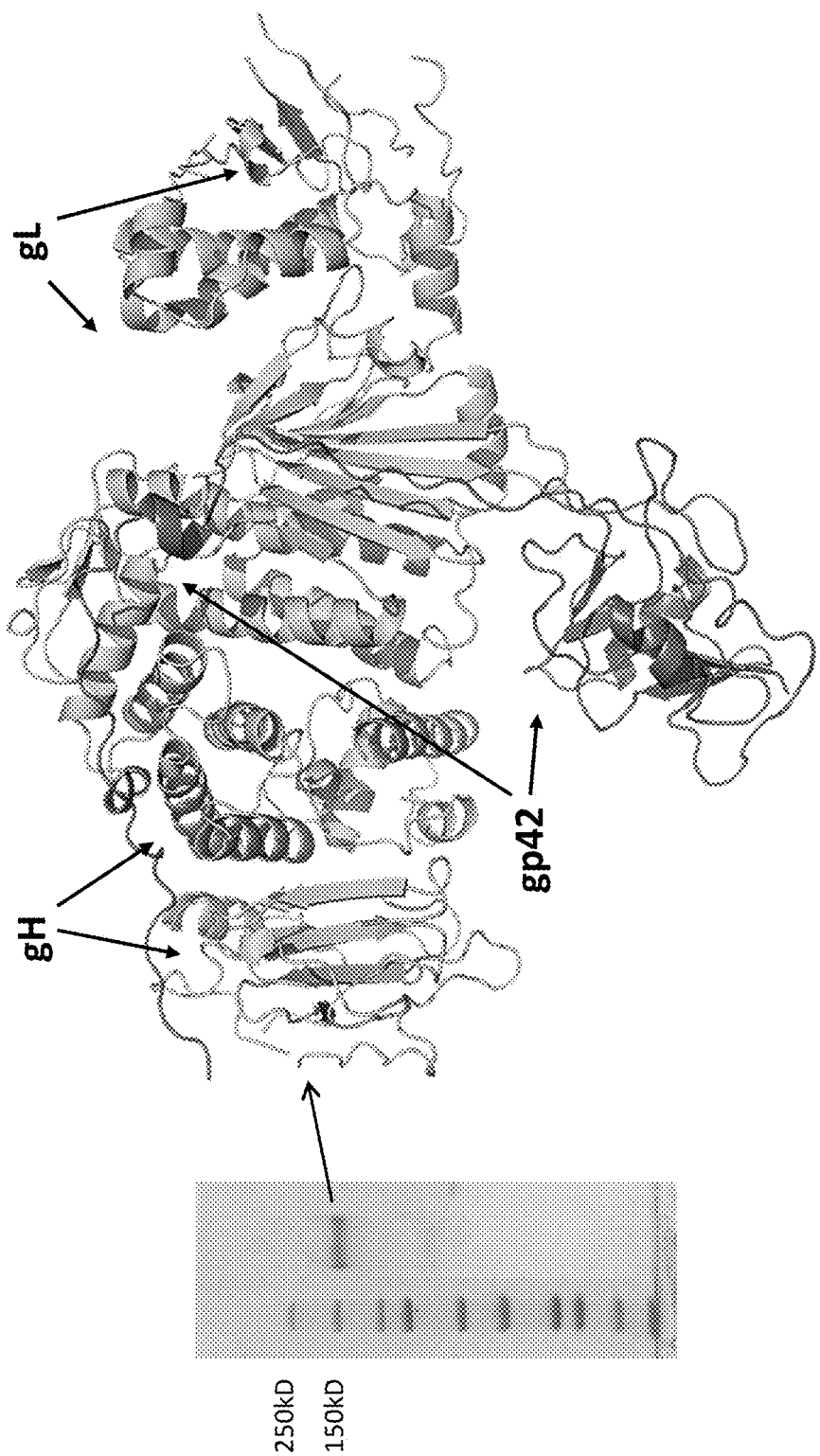

The crystal structure of a gH/gL/gp42 His-tagged fusion (SEQ ID NO: 226) has been solved to show that the single-chain gH/gL/gp42 can adopt a heterotrimer conformation similar to wild-type gH, gL, and gp42 proteins found in nature (FIGS. 85 and 86B). In FIGS. 85 and 86B, Gp42 (in dark gray and indicated with arrows in FIG. 85) interacts with the gH/gL heterodimer. FIG. 86C is a model of how this single-chain gH/gL/gp42 heterotrimer fused to ferritin is displayed on a nanoparticle. There are twenty-four copies of the single-chain gH/gL/gp42 that will be displayed on a single nanoparticle.

Figure 79A:
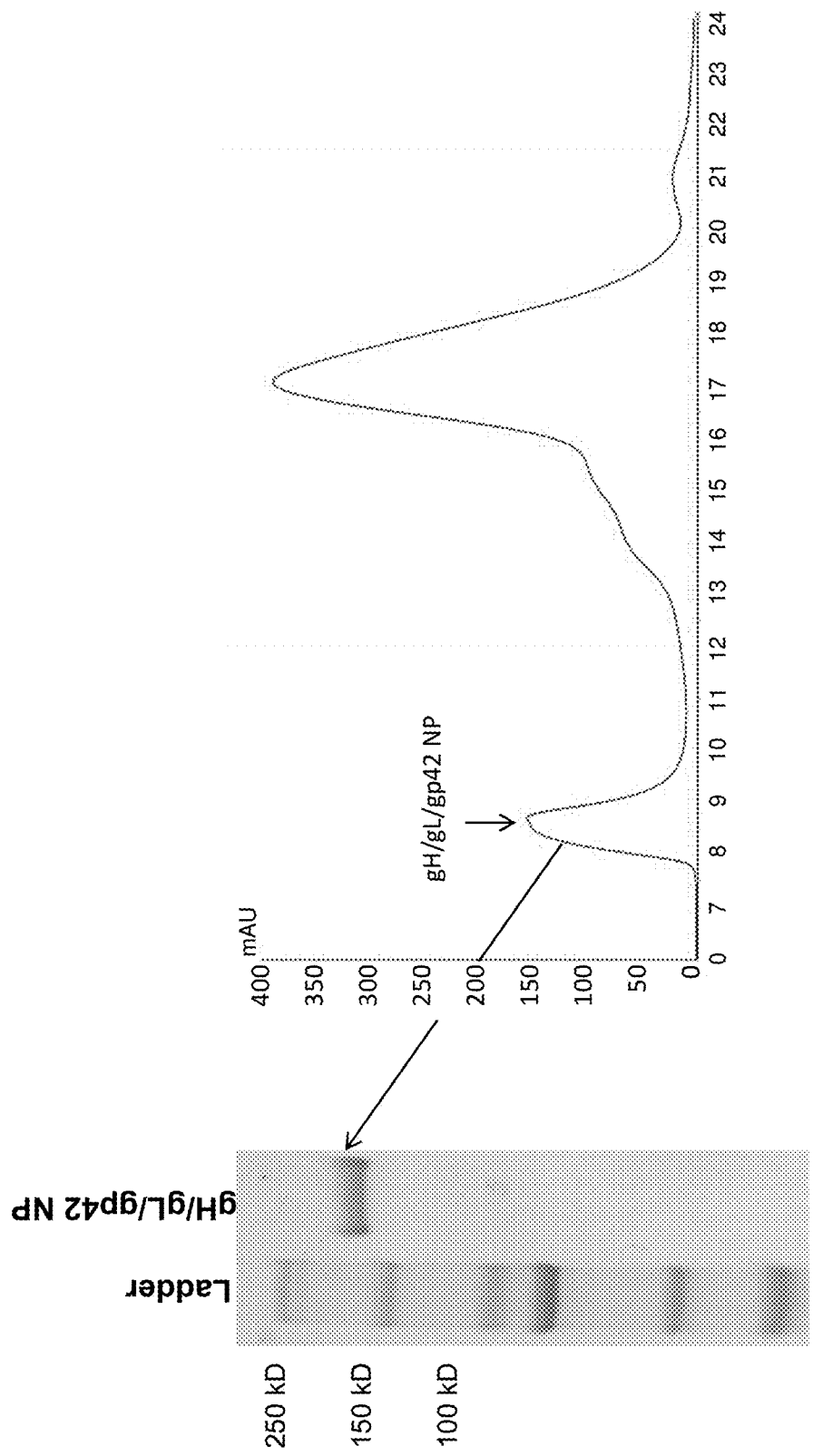
Figure 79B:
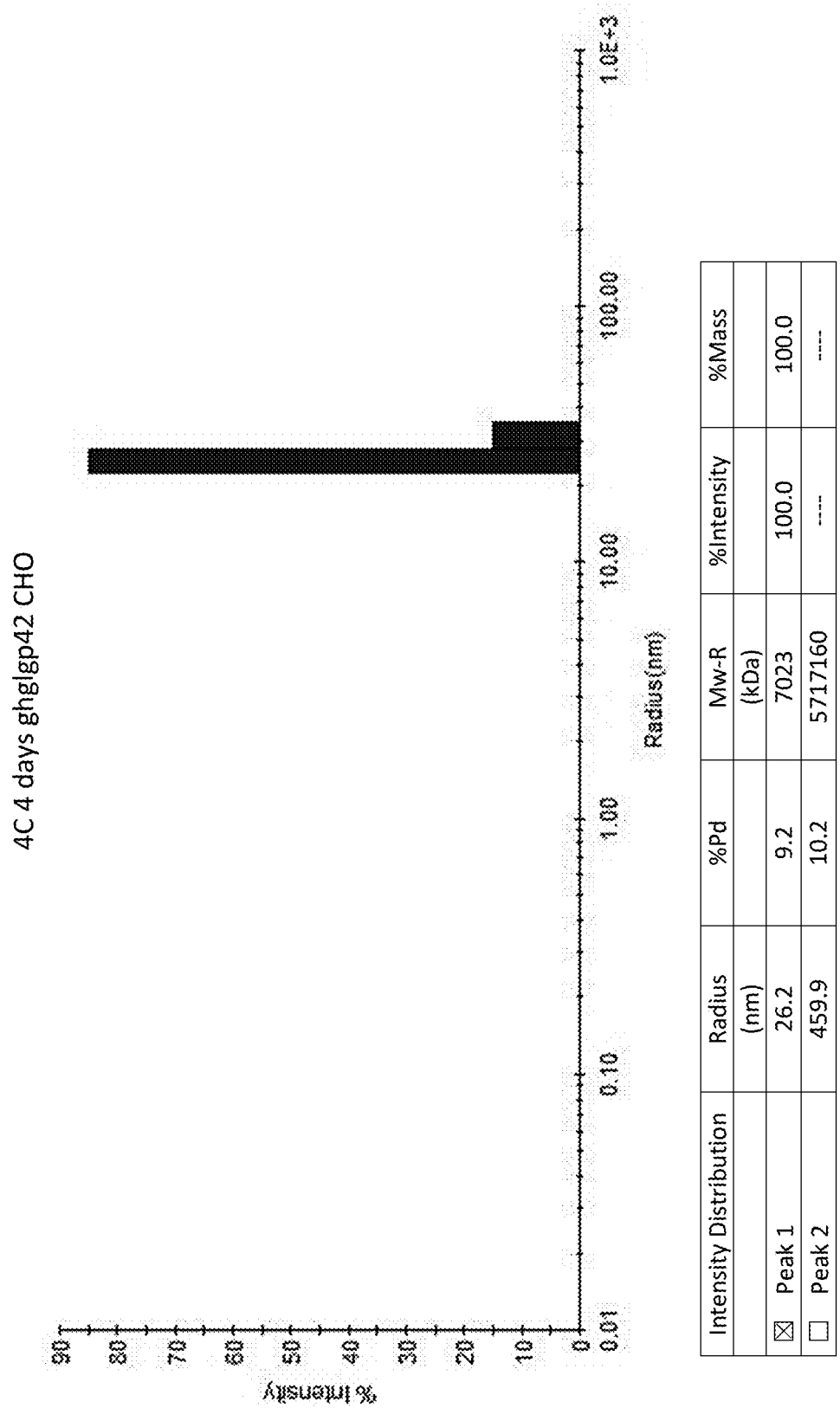

A gH/gL/gp42 NP construct (SEQ ID NO: 227) was expressed in 293 expi cells and purified (FIG. 79A). gH/gL/gp42 NP purified from CHO pools had a dynamic light scattering radius of around 26.2 nm (FIG. 79B).

Figures 80A, 80B:
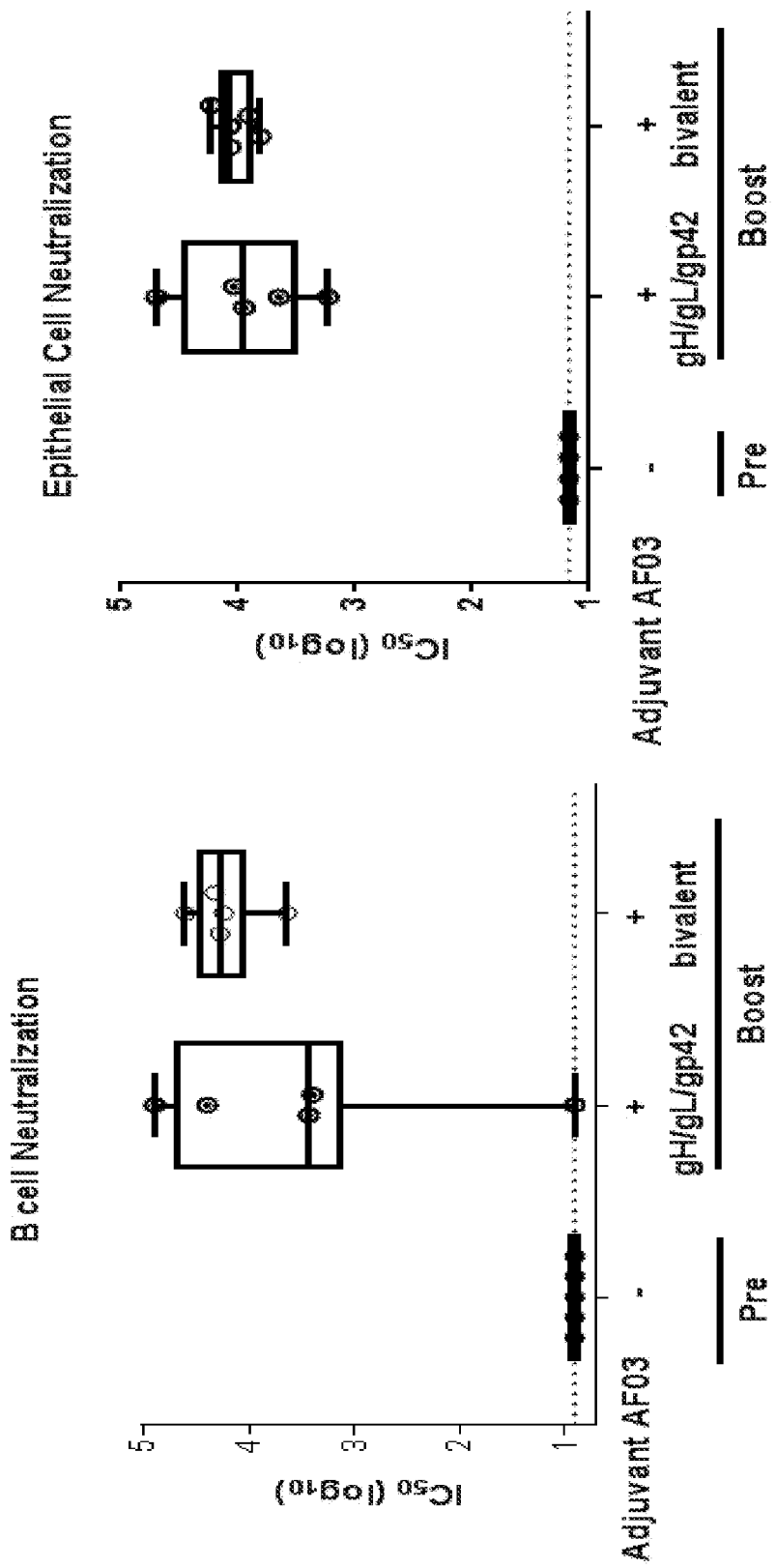

The immune responses elicited by a monovalent (gH/gL/gp42 NP+naked ferritin nanoparticle) or bivalent (gH/gL/gp42 NP+gp220 NP) composition were assessed. The gH/gL/gp42 NP had the sequence of SEQ ID NO: 227 and the gp220 NP had the sequence of SEQ ID NO: 1. BALB/c mice (n=5/group) were immunized with a 3-week interval between doses. 100 μL of the nanoparticle composition containing 1 μg of each nanoparticle was administered with an AF03 adjuvant (1:1 volume of AF03 mixed with vaccine). The boost indicates the sera collected at week 5 after the second immunization. EBV viral neutralizing assay analysis in B cells (FIG. 80A) and in epithelial cells (FIG. 80B) was done using sera collected at week 5 from the mice. No interference was seen due to administration of the nanoparticles in bivalent formulation, as compared to administration of the monovalent form (gH/gL/gp42 with naked ferritin).

Figure 81A:
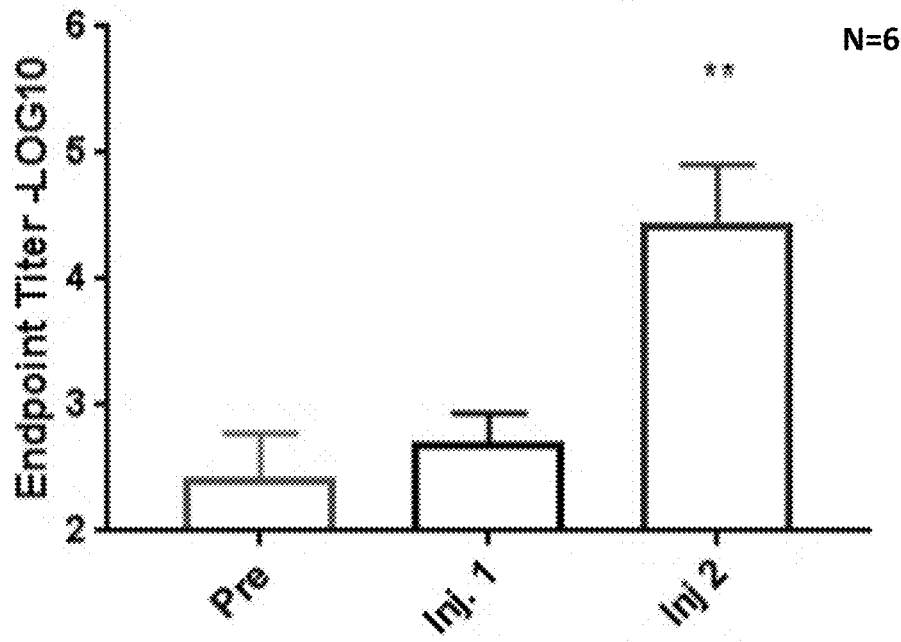
Figure 81B:
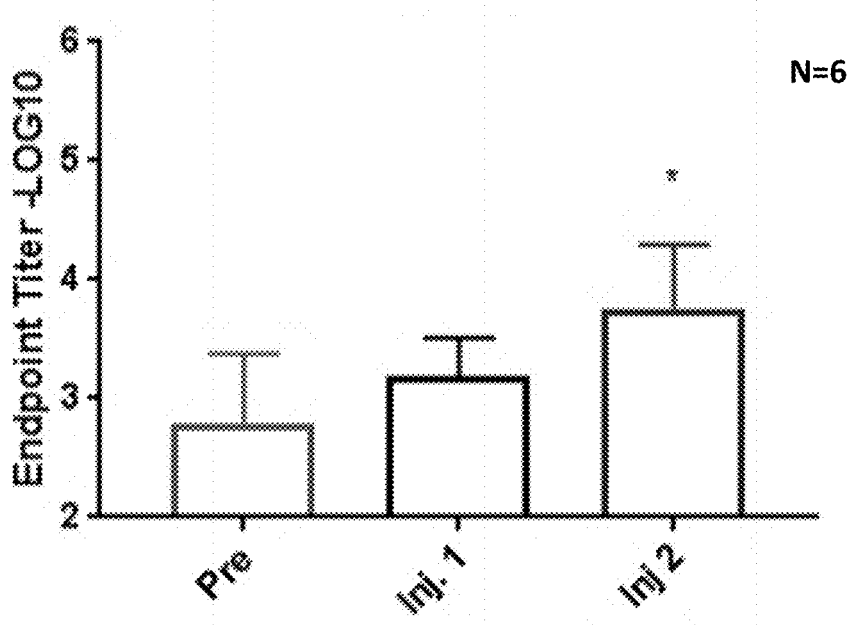
Figures 81C, 81D:
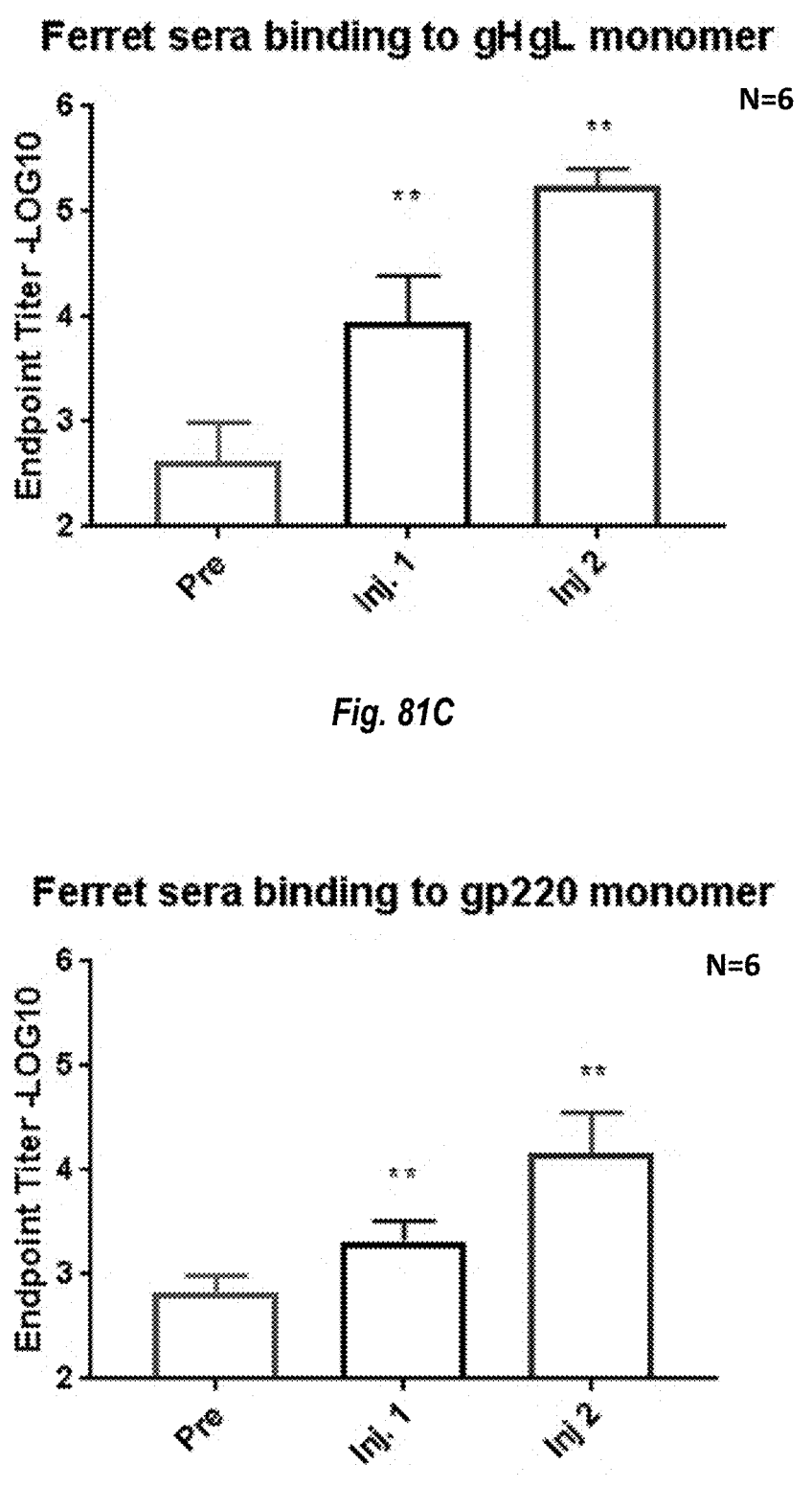
Figure 81E:
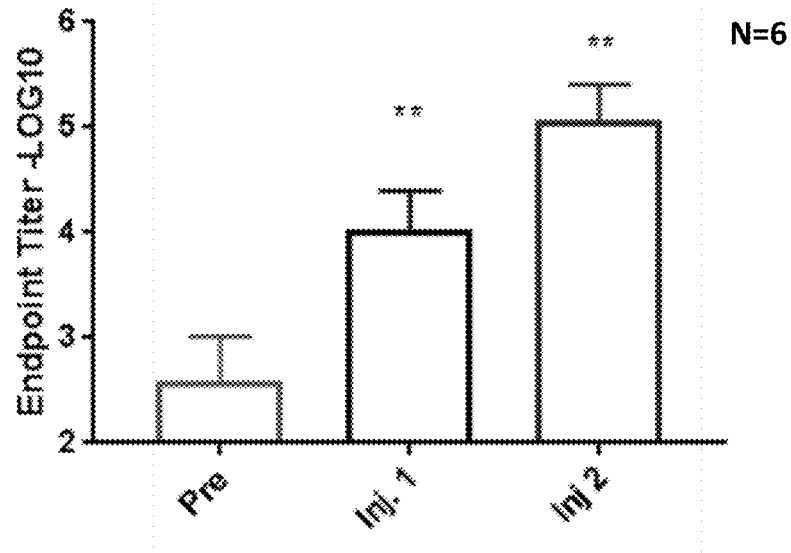
Figure 81F:
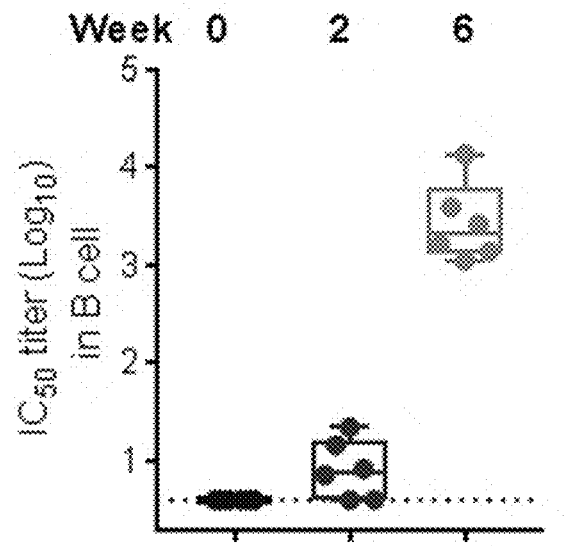
Figure 81G:
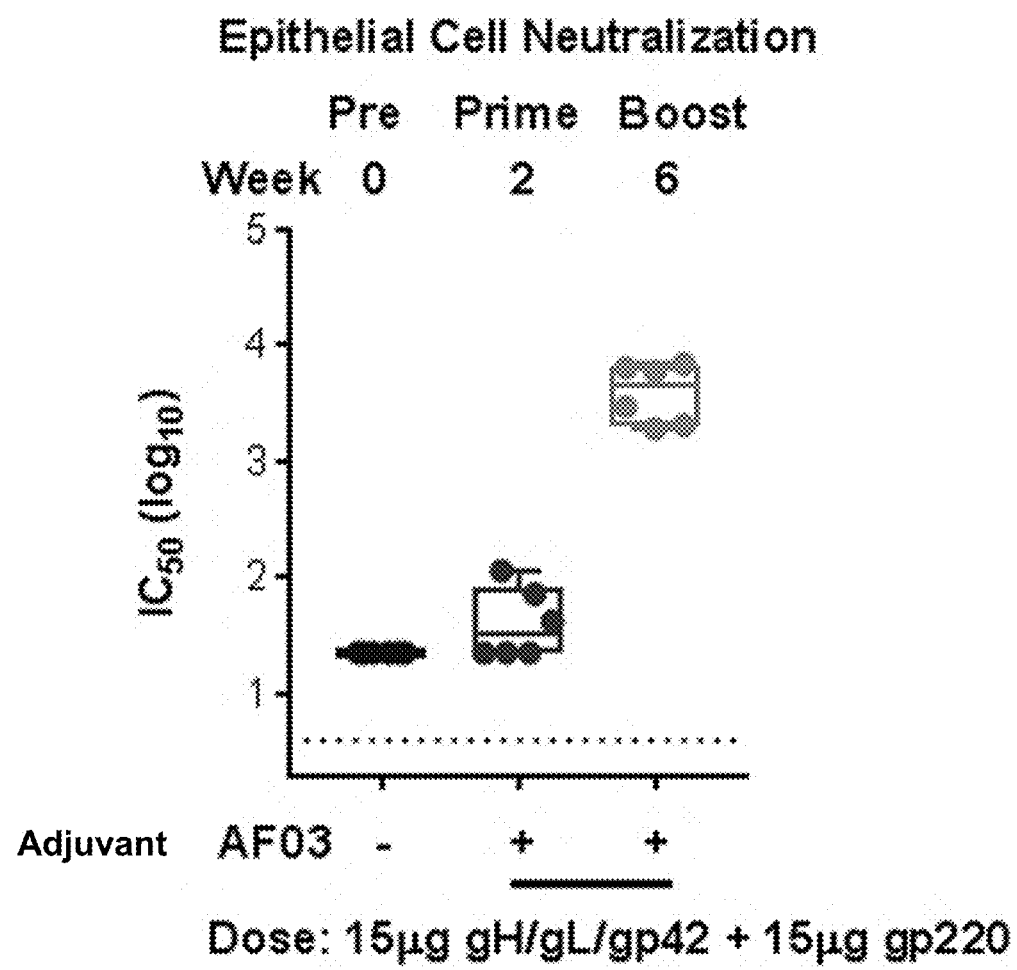
Figure 82A:
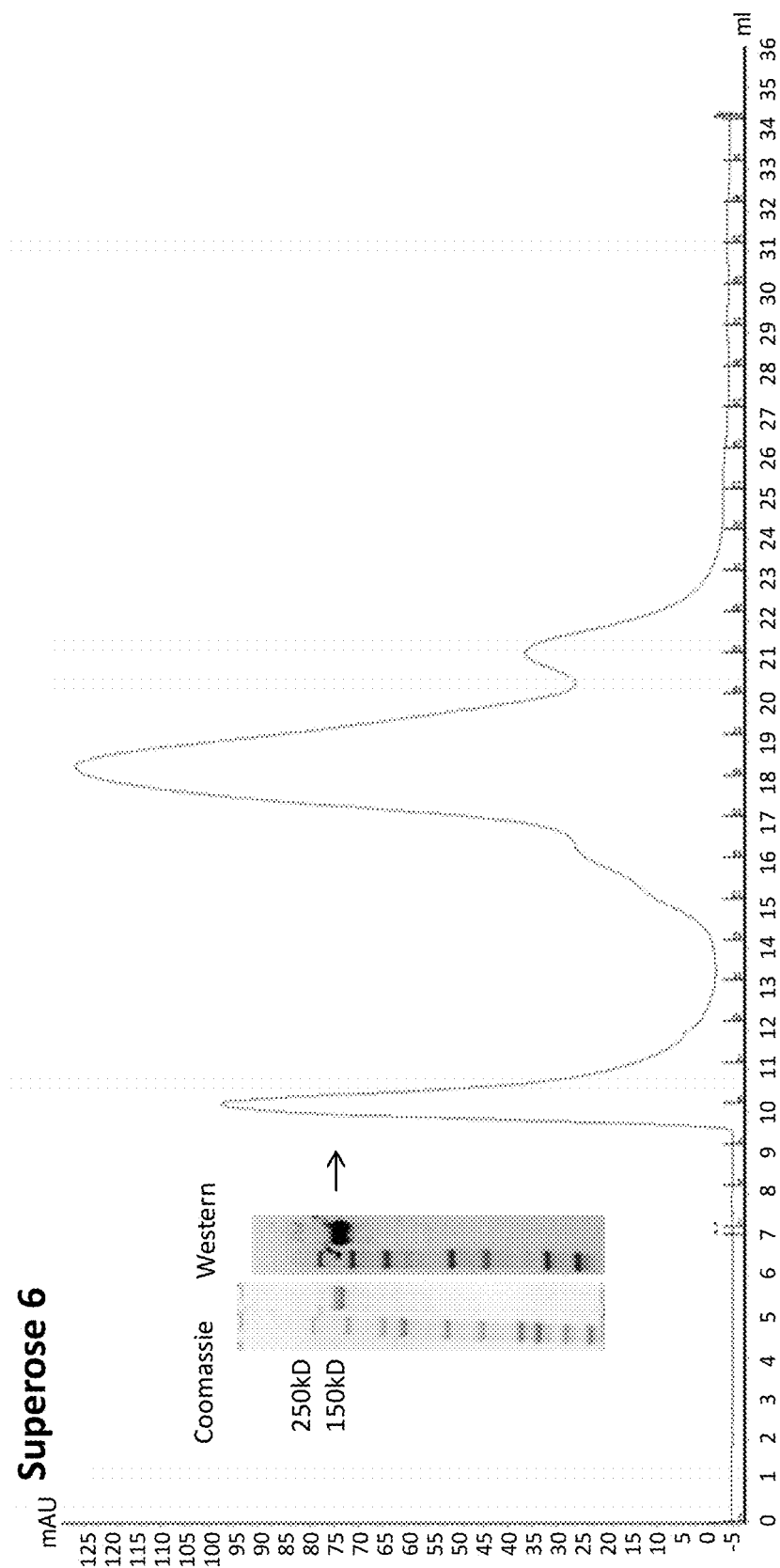
Figure 82B:
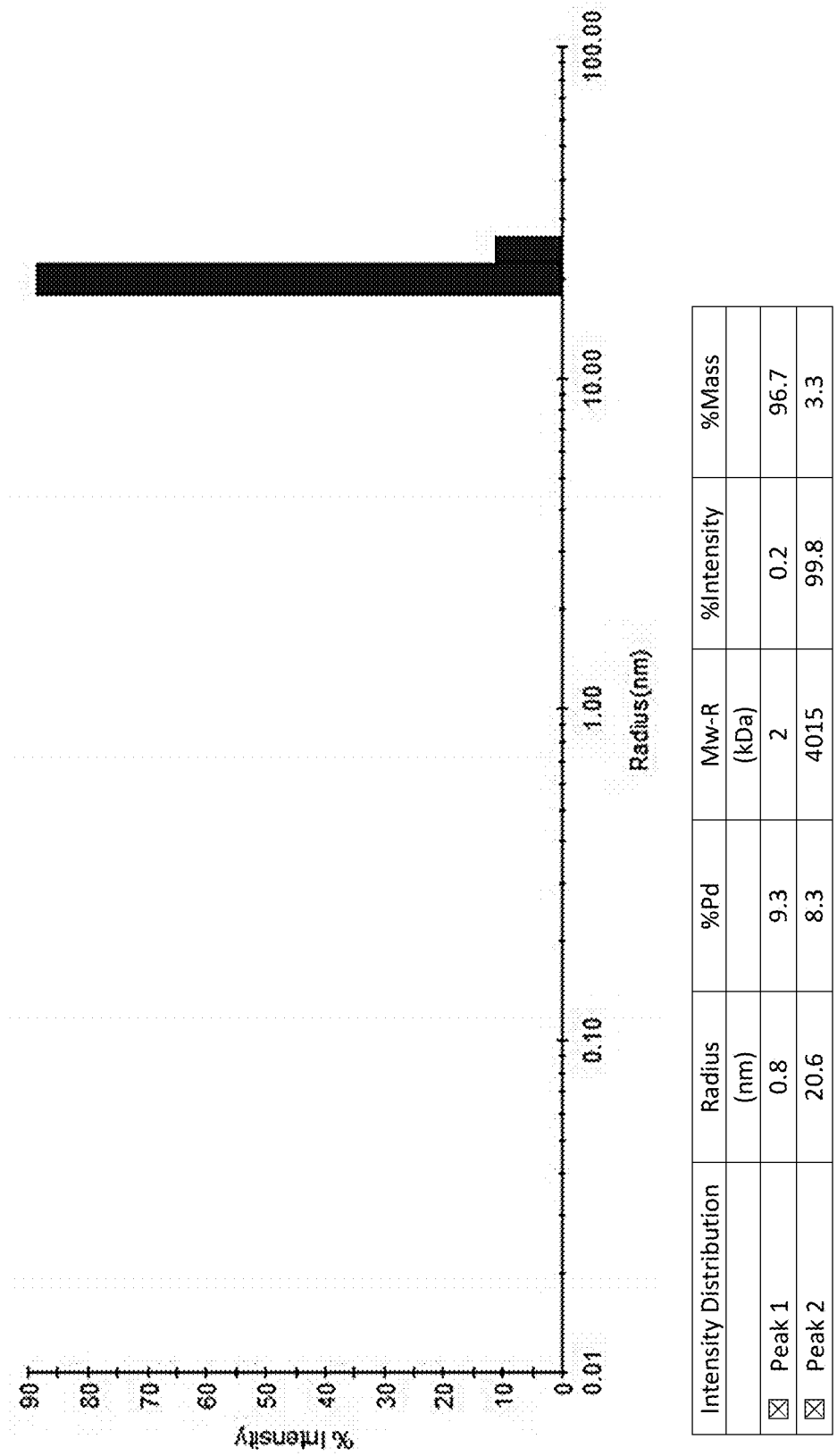
Figure 83A:
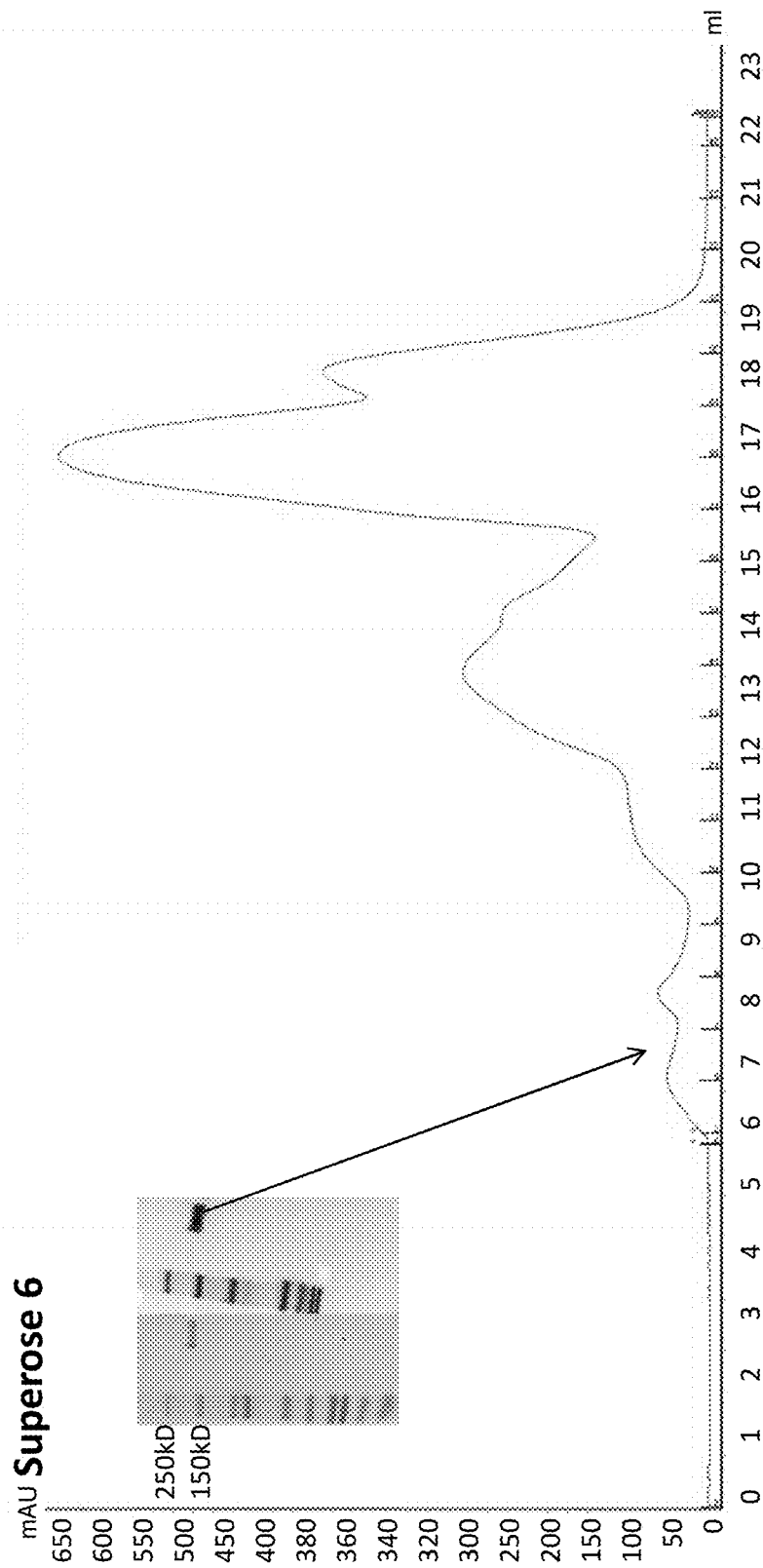
FIG. 83B is a dynamic light scattering analysis of the sample in FIG. 32A, which shows the particle size radius of 17.1 nm.
Figure 83B:
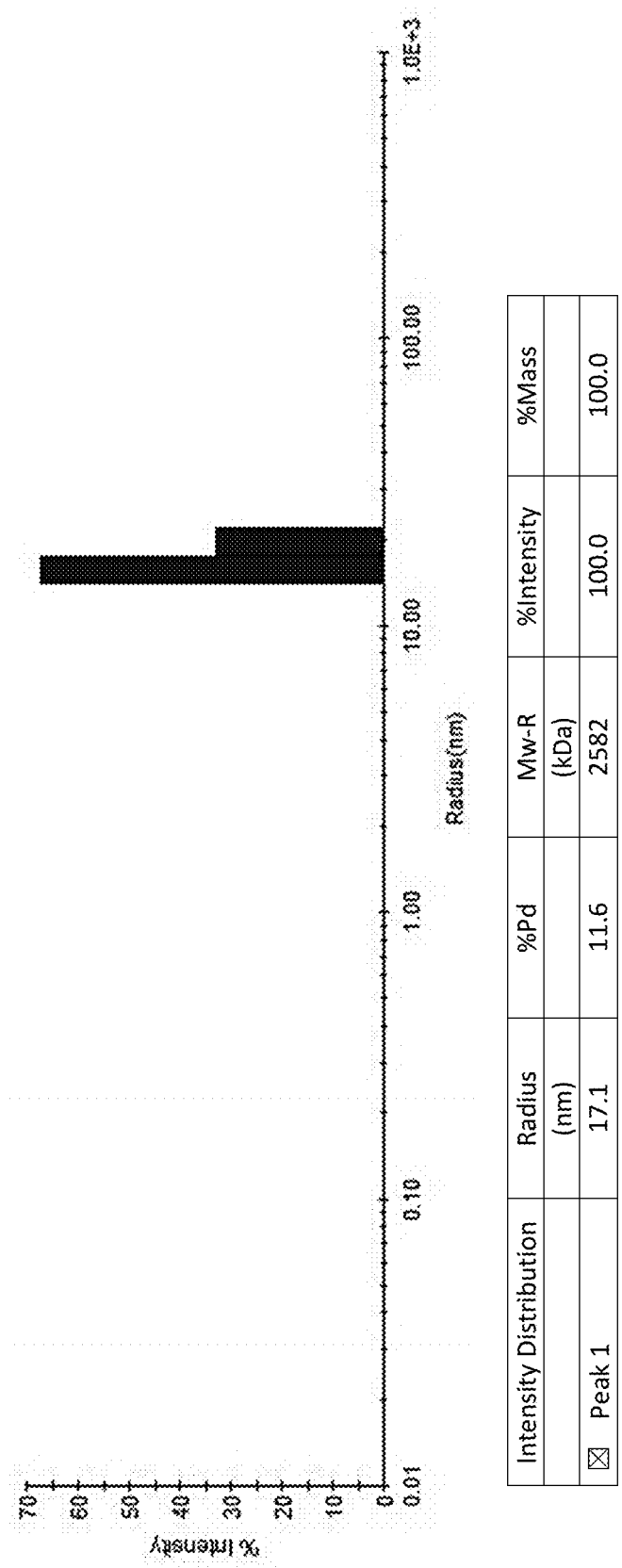
Figure 84A:
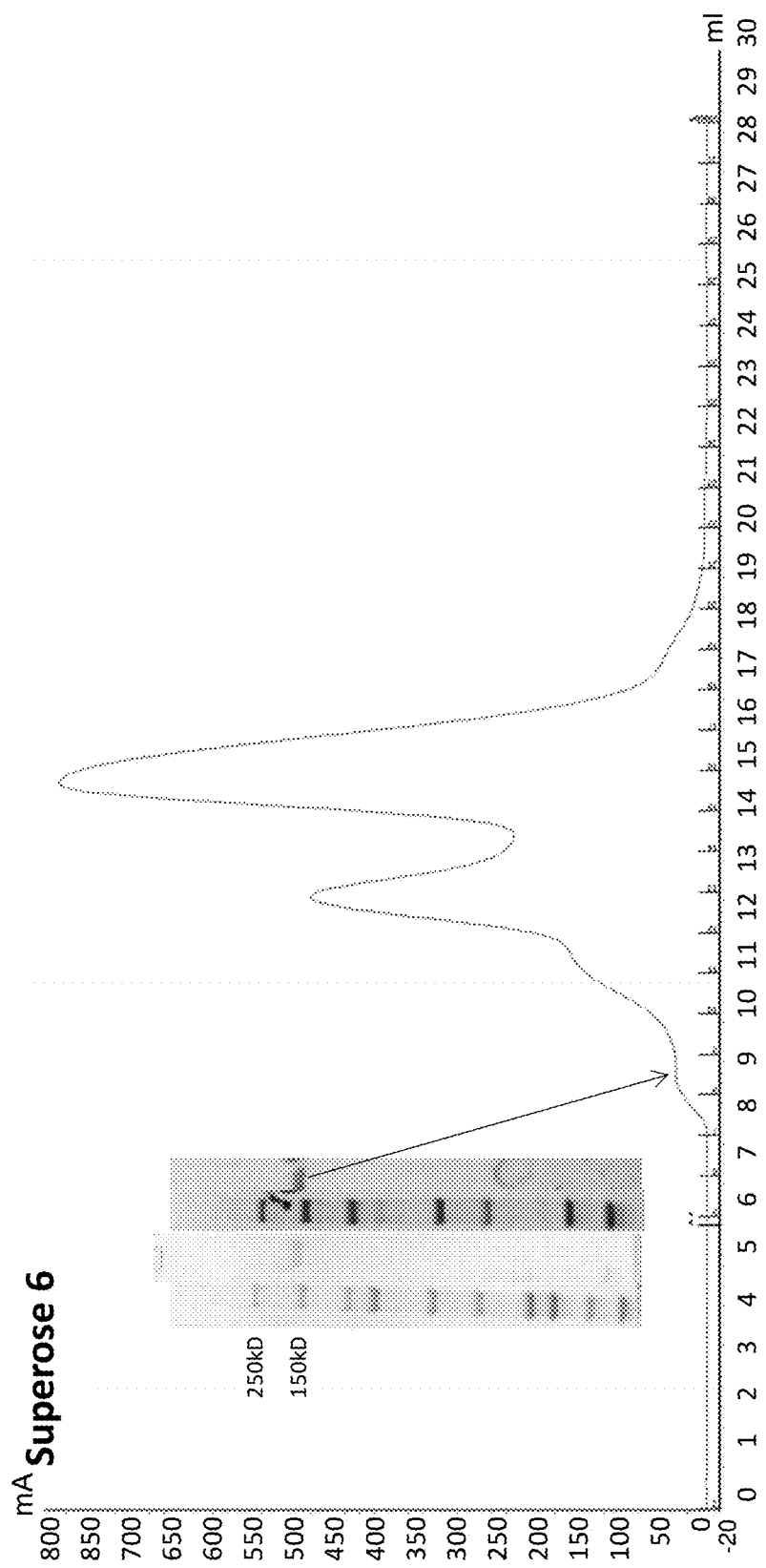
FIGS. 84A-B.
Figure 84B:
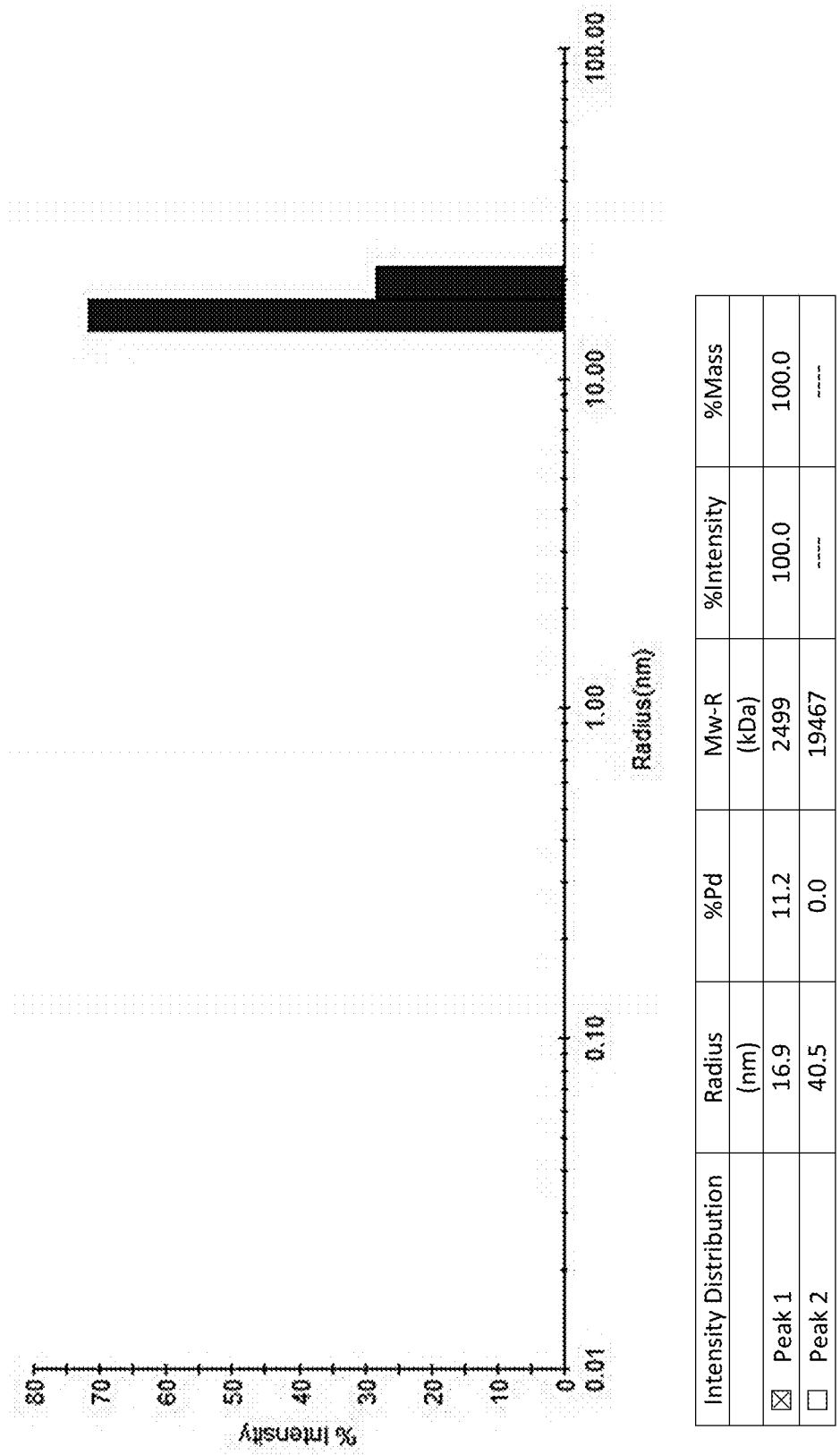

Bivalent immunization of ferrets was performed using compositions comprising single-chain gL/gH nanoparticles (gL_gH_C137A_bfpFerr Nanoparticle N19Q/C31S/S111C [SEQ ID NO: 22]) and gp220 nanoparticles (SEQ ID NO: 1) in the presence of adjuvant AF03 (FIGS. 81A-81B) or gL/gH/gp42 NP (SEQ ID NO: 227) and gp220 nanoparticles (SEQ ID NO: 1) in the presence of adjuvant AF03 (FIGS. 81C-81E). Inj. 1=injection one (sera collected from 6 ferrets at week 2 post Inj. 1). Inj. 2=injection 2 (sera collected from 6 ferrets at week 2 post Inj. 2). An ELISA binding assay measured endpoint binding titers against the antigens indicated in FIGS. 81A-81E. FIGS. 81F-G shows an EBV viral neutralizing assay (in B cells and epithelial cells, respectively) of sera from ferrets receiving bivalent vaccination of gL/gH/gp42 NP (SEQ ID NO: 227) and gp220 nanoparticles (SEQ ID NO: 1) in the presence of adjuvant AF03. Prime=Inj. 1 and Boost=Inj. 2.

gH/gL/gp42_NP_C12 (SEQ ID NO: 228) was expressed and purified using Superose 6 size exclusion chromatography (FIG. 82A). A dynamic light scattering analysis of the sample in FIG. 82A showed a particle size radius of 20.6 nm (FIG. 82B).

gH/gL/gp42_NP_C13 (SEQ ID NO: 229) was expressed and purified using Superose 6 size exclusion chromatography (FIG. 83A). A dynamic light scattering analysis of the sample in FIG. 83A showed a particle size radius of 17.1 nm (FIG. 83B).

gH/gL/gp42_NP_C14 (SEQ ID NO: 230) was expressed and purified using Superose 6 size exclusion chromatography (FIG. 84A). A dynamic light scattering analysis of the sample in FIG. 84A showed a particle size radius of 16.9 nm (FIG. 84B).

FIG. 86D shows the purification of SEQ ID NO: 227 after expression in 293Expi cells. A denaturing SDS coomassie gel shows the gH/gL/gp42 fused to ferritin to be above 150 kD with glycosylation. Negative stain electron microscopy analysis of the purified product shows the single-chain gH/gL/gp42 fused to ferritin can successfully form nanoparticles displaying the gH/gL/gp42 antigens on the surface (FIG. 86E). Through temperature, oxidation, and/or deamidation stress test on days 0, 3, 7, or 14, potential labile sequences have been identified via sequence analysis or mass spectrometry for the single-chain gH/gL/gp42 nanoparticle of SEQ ID NO: 227. To improve vaccine stability, expression, and/or immunogenicity of this vaccine construct, conservative amino acid substitution mutations will be made to SEQ ID NO: 227 in different combinations, particularly at the sites listed in Table 1. Conservative amino acid mutations at the respective location in the particular gene will also be tested in SEQ ID NOs: 228-230, which differ from SEQ ID NOs. 227 only by the linker sequence that fuses the C-terminus of gp42 with the N-terminus of the ferritin sequence.

Example 20: Design and Characterization of Modifications to RSV F Polypeptides

Figure 87A:
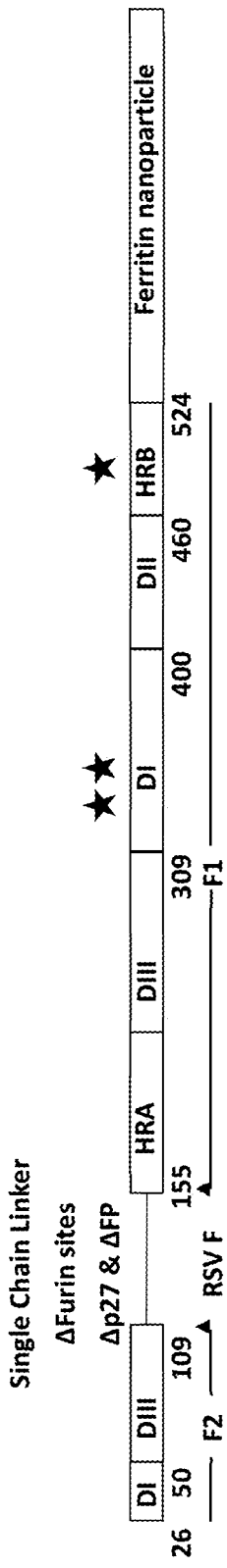

Like other paramyxovirus F proteins, RSV F is expressed as a precursor protein with an N-terminal signal peptide and a C-terminal transmembrane region that anchors the protein to the viral surface. RSV F undergoes intracellular cleavage by the protease furin to release a hydrophobic fusion peptide ("FP" in FIG. 87A), whose role is to attach to the target cell during infection. Adjacent to the fusion peptide is the heptad repeat region A (HRA) while the heptad repeat region B (HRB) is adjacent to transmembrane domain.

Figure 87B:
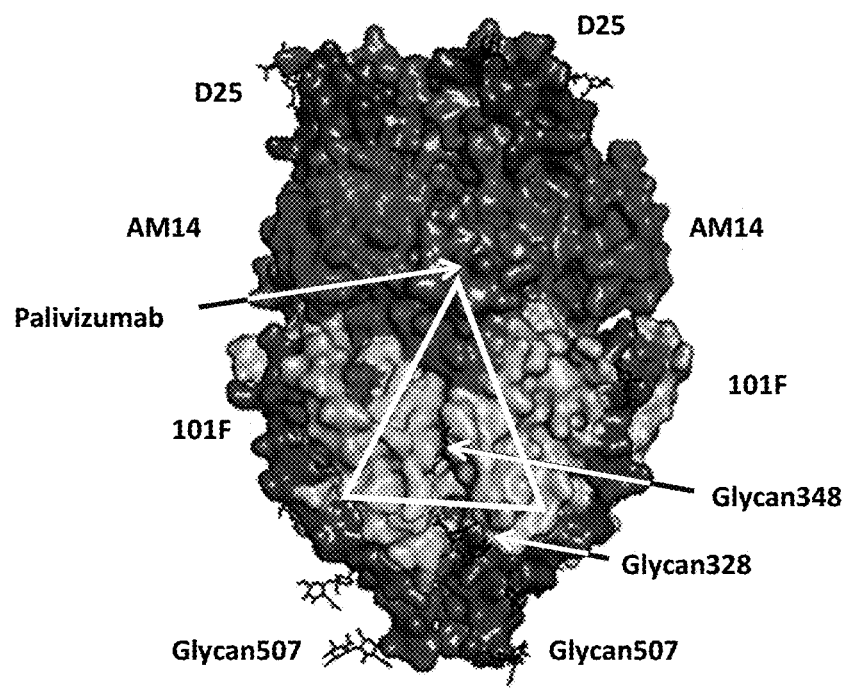
Figure 87C:
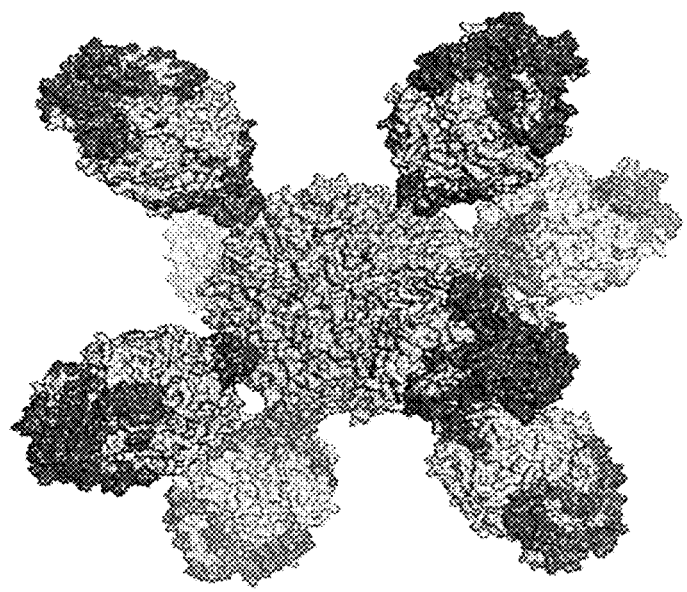
Figure 87D:
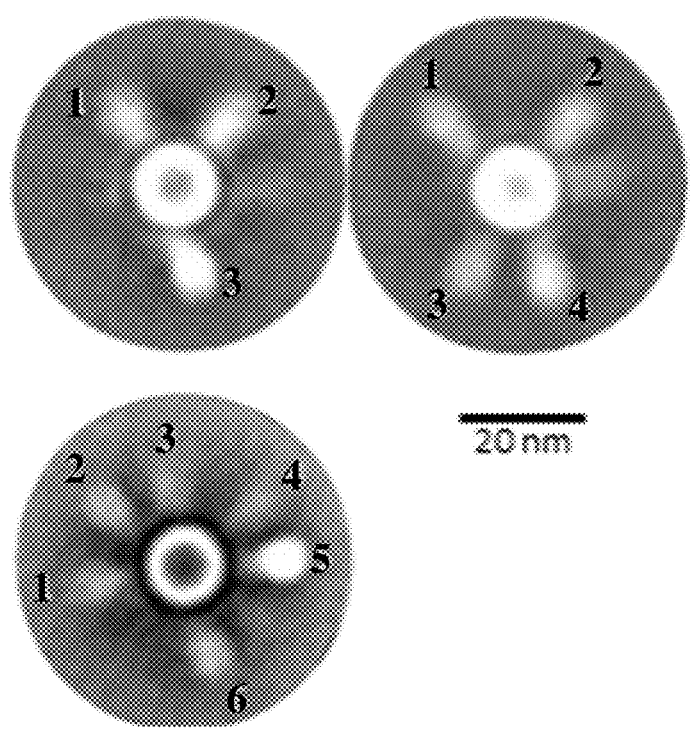
Figure 89:
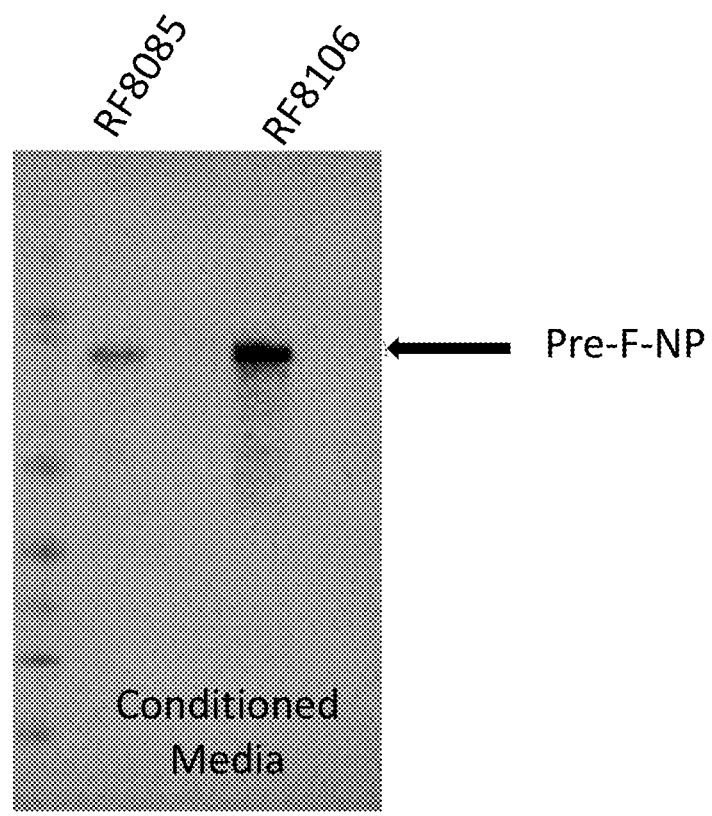
Figure 90:
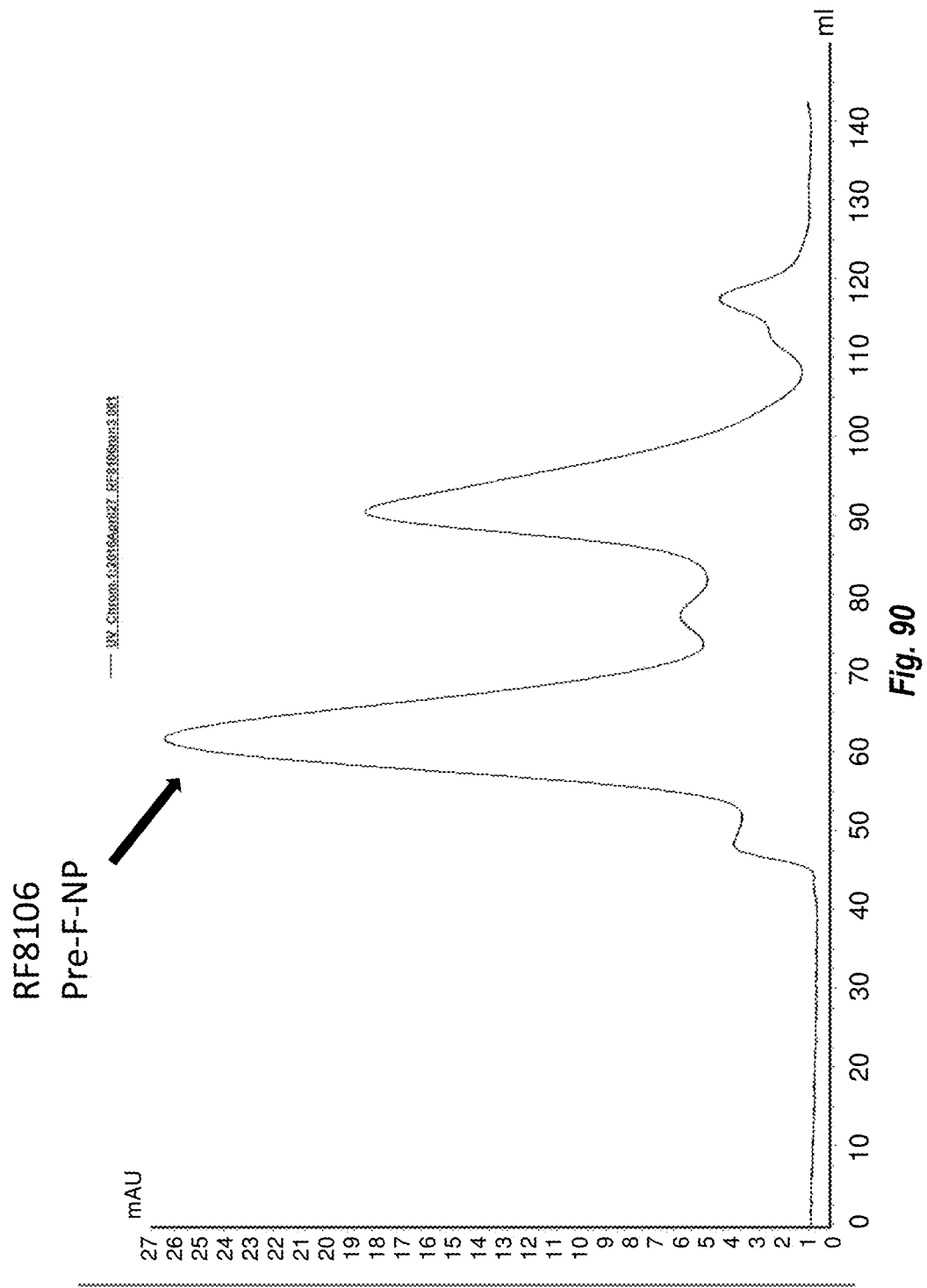
Figure 91A:
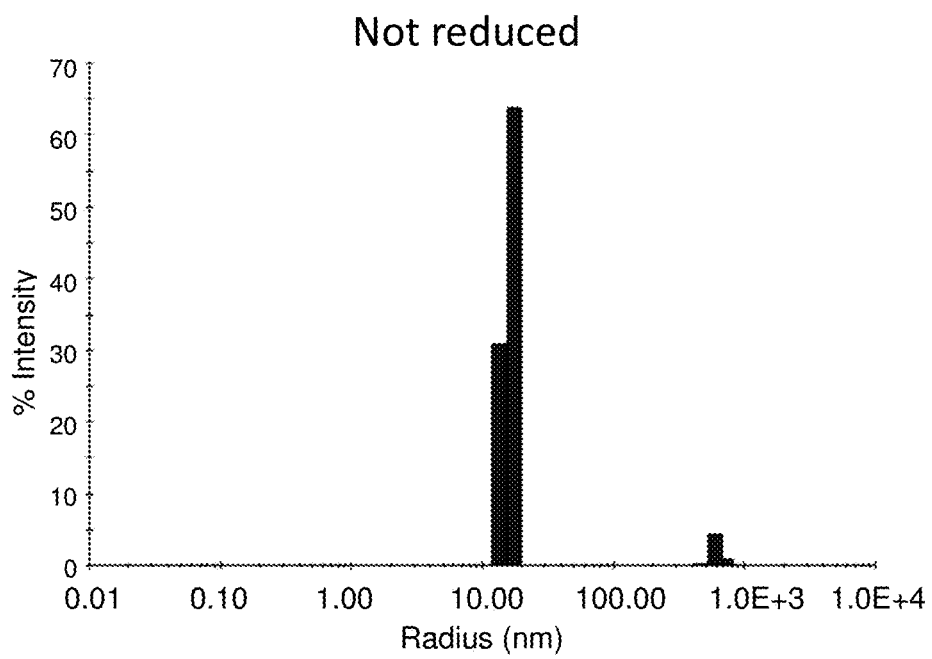
Figure 91B:
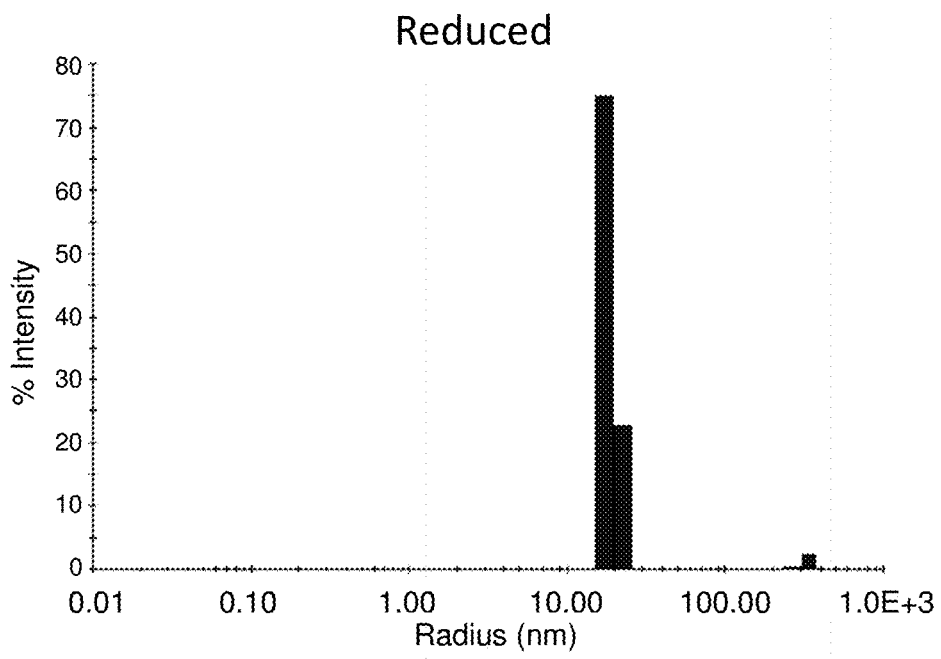
Figure 92:
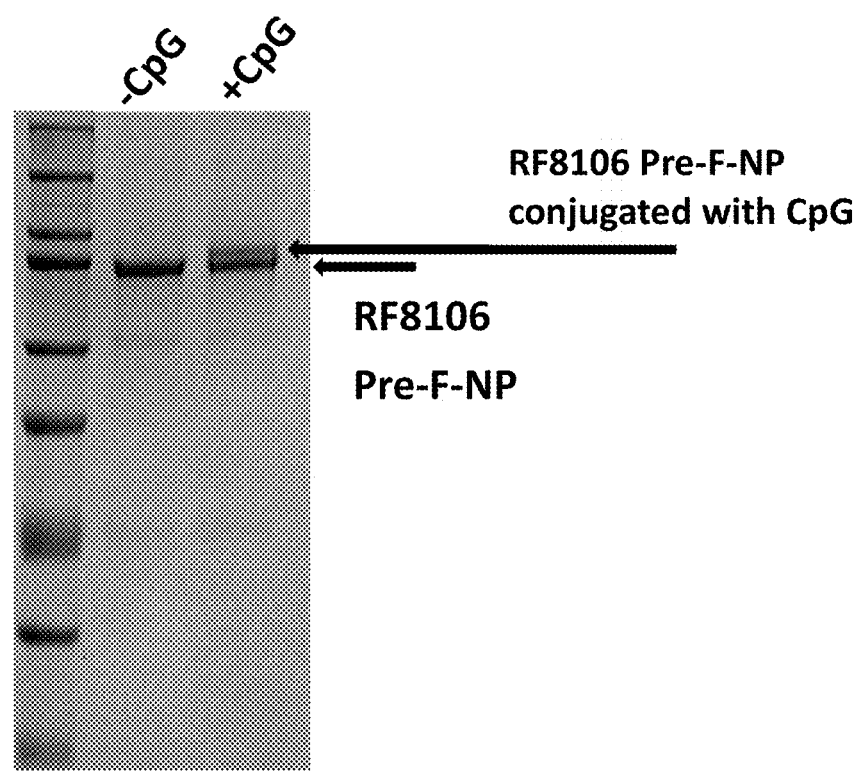

Crystal structures of RSV F ectodomain trimers in their pre-fusion and post-fusion conformations demonstrate how the HRA and HRB regions undergo significant rearrangement to drive the cellular fusion event (FIG. 87B) (see Swanson, K. A., et al., Proc Natl Acad Sci USA 108(23): p. 9619-24 (2011); McLellan, J. S., et al., Science 342(6158): 592-598 (2013); McLellan, J. S., et al., J Virol 85(15):7788-96 (2011); and McLellan, J. S., et al., Science 342(6158): p. 592-8 (2013)). In the pre-fusion conformation, the heptad repeat A (HRA) region is associated with the globular head, and the tip of the fusion peptide is mostly buried in the center of the protein. The pre-fusion conformation contains a number of helices and involves certain contacts between protomers to form a pre-fusion trimer.

A series of amino acid substitutions were designed to be inter-protomer stabilizing. Exemplary substitutions include V207L; N228F; I217V and E218F; I221L and E222M; or Q224A and Q225L. All RSV F amino acid sequence numbering in the examples uses the numbering of SEQ ID NO: 526.

Amino acid substitutions were designed to be helix stabilizing. As such, these substitutions are predicted to stabilize the helical domain of RSV F. Exemplary substitutions include N216P or I217P.

Amino acid substitutions were designed to be intra-protomer stabilizing. Exemplary substitutions include V220I; or A74L and Q81L.

Amino acid substitutions were designed to be helix capping. Exemplary substitutions include N216P or I217P.

Amino acid substitutions were designed to decrease aggregation. Exemplary substitutions include V192E and L61Q.

Figure 93:
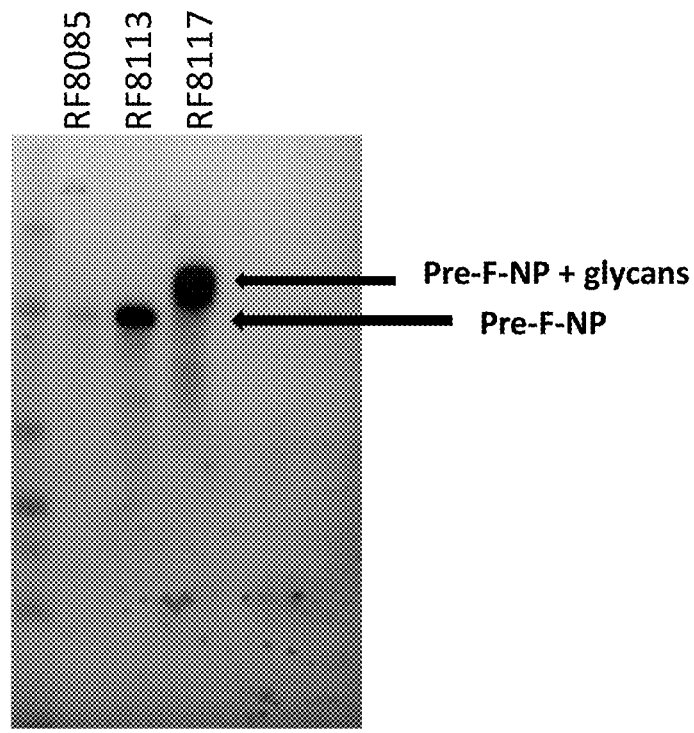

Other amino acid substitutions were designed to be cavity-filling by introducing hydrophobic amino acids such as N228F Amino acid substitutions E328N, S348N, and R507N were designed to add glycosylation sites by replacing non-asparagine residues with asparagine. It was hypothesized that addition of non-native glycans could be used to block epitopes that are exposed in the post-fusion RSV F (FIG. 87B) on the pre-fusion F protein surface.

RSV F constructs of interest were generated as single chain (scF) fusion proteins with a hybrid ferritin comprising an N-terminal bullfrog ferritin linker and *H. pylori* ferritin (pFerr) (FIG. 87A). The ferritin comprised a surface-exposed cysteine resulting from a K79C or S111C mutation (ferritin sequence numbering corresponds to SEQ ID NO: 208).

Generation of the various RSV Pre-F-NP and ferritin coding sequences was performed using standard cloning practices known in the field. Generally speaking, DNA for RSV F constructs with the described substitutions was synthesized and cloned into a mammalian expression vector by Genscript. RSV F DS-CAV1 and post-fusion F trimers were generated similarly to the protocols previously published (see McLellan, J. S., et al., Science 342(6158):592-598 (2013)). The DS-CAV1 construct retained the C terminal trimerization domain of RSV F and combined it with cavity-filling hydrophobic substitutions. The RSV F DS-CAV1 comprises a S155C-S290C disulfide multination (DS) and a 5190E-V207L (CAV1).

Vectors encoding RSV F-ferritin nanoparticles, naked ferritin (i.e., not coupled to RSV F), and RSV F trimers were transfected into 293EXPI cells, and expression products were harvested from the conditioned media after 4 days. RSV F nanoparticles were purified by a series of anionic Q column purifications (GE Healthcare, Cat #17-1154-01) at pH 7.0 and 8.5 followed by Superose 6 SEC purification in PBS (GE Healthcare Cat #90-1000-42) using conventional chromatography methods. DS-CAV1 pre-fusion trimers and post-fusion trimers were stored at −80° C. and RSV F nanoparticles were stored at 4° C.

To determine the conformation of RSV F nanoparticles, electron microscopy was performed. RSV F nanoparticle preparations (30 μg/mL in 25 mM Tris, 50 mM NaCl) were absorbed onto a 400-mesh carbon-coated grid (Electron Microscopy Sciences) and stained with 0.75% uranyl formate. A JEOL 1200EX microscope, operated at 80 kV, was used to analyze the samples. Micrographs were taken at 65,000× magnification and 2D class averages were prepared using conventional methods in the field by the EM company Nanoimaging Services, INC (San Diego, CA) (FIG. 87D).

Expression and secretion of polypeptides comprising these RSV F polypeptides and ferritin (SEQ ID NOs: 501-508 and 511-515) by transiently transfected 293 EXPI cells (Invitrogen) were evaluated by anti-RSV F Western blot. All anti-RSV F Western blots used the site 0-specific D25 antibody described in McLellan et al., Science 340 (6136):1113-1117 (2013) and U.S. Pat. No. 8,562,996. As shown in FIG. 88, many constructs were successfully expressed and secreted.

The RF8085 polypeptide (SEQ ID NO: 501) represents a single chain mutant of the published DS-CAV1 RSV F (see McLellan, J. S., et al., Science 342(6158):592-598 (2013)) fused N-terminally to ferritin nanoparticle. This construct comprises a S155C-S290C double mutant (DS) of RSV F that retains antigenic site 0.

The RF8106 polypeptide (SEQ ID NO: 509) has an I217P substitution instead of the 2 cysteines substituted into DS-CAV1. As shown in FIG. 89, the RF8106 construct had significantly better expression in transiently transfected 293 EXPI cells as assessed from conditioned media after 4 days by anti-RSV F Western blot.

Size exclusion chromatography (SEC) of RF8106 showed elution of a main peak at a retention time consistent with an assembled ferritin particle fused to the RSV antigen consistent with a fusion protein nanoparticle (Pre-F-NP, FIG. 90). Dynamic light scattering (DLS) analysis of RF8106 was done in the reduced (FIG. 91B) and non-reduced states (FIG. 91A). Reduction was by treatment with 2 mM TCEP. RF8106 had a radius of approximately 15 nm, which is consistent with incorporation into a nanoparticle (24-mer) in both the reduced and nonreduced states. Stability of the fusion protein to reducing agents facilitates conjugation of adjuvants to the fusion proteins to form self-adjuvanting nanoparticles, as described below.

Next, conjugation of an adjuvant to the fusion protein of RSV F polypeptide and ferritin (Pre-F-NP) was assessed. It was found that the free surface cysteine on the ferritin can be used to attach an additional moiety to the scF-pFerr fusion protein. FIG. 92 shows successful conjugation of a CpG oligodeoxynucleotide (ODN) with the sequence T*G*A*C*T*G*T*G*A*A*C*G*T*T*C*G*A*G*A*T*G*A (SEQ ID NO: 530; asterisks indicate phosphorothioate linkages) to RF8106, as evidenced by an increase in the molecular weight as assessed by Coomassie-stained SDS-PAGE gel.

The effect of adding glycosylation sites using E328N, S348N, and R507N substitutions (RF8117, SEQ ID NO: 517) was assessed in 293EXPI cells transiently transfected with this construct as a fusion protein with ferritin (i.e., as Pre-F-NP constructs). RF8117 also contains an I217P substitution, as in RF8113. As shown in FIG. 93, increased expression was seen for RF8117 as compared with both the RF8085 control construct and the RF8113 construct (SEQ ID NO: 516, which comprises a proline substitution of I217P but not the E328N, S348N, and R507N substitutions). RF8113 is similar to RF8106 described previously except the engineered ferritin cysteine is on ferritin residue K79C rather than S111C. The RF8117 construct also showed an increase in the molecular weight of the RF8113 and RF8117, indicating the successful addition of glycans.

Figure 94:
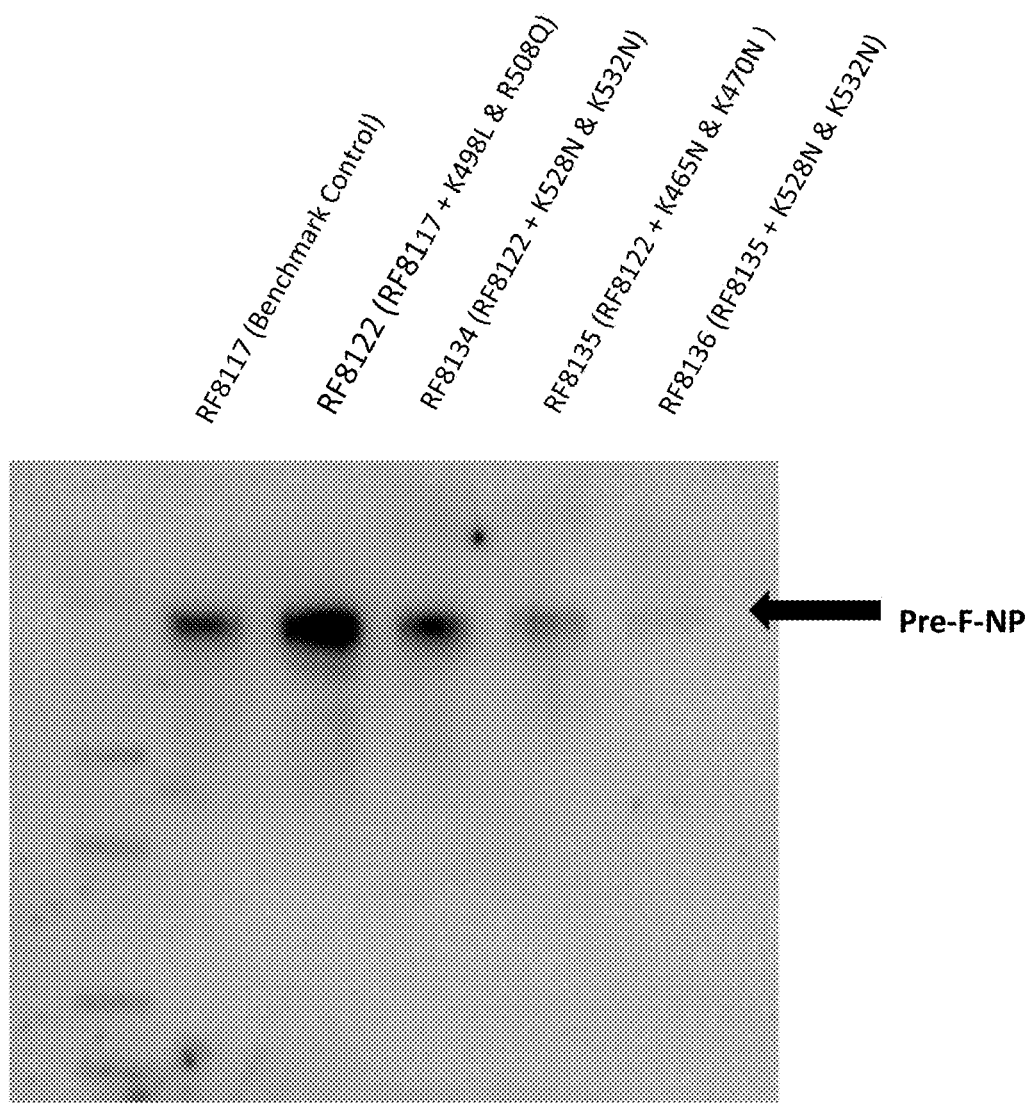
FIG. 94 shows expression of RSV F constructs with different substitutions at potential trypsin-like protease cleavage sites. It was observed in CHO cell line expression of RF8090 (same protein sequence as RF8085 with a different DNA sequence adapted to the CHO expression vector) that the polypeptide was clipped between the F and ferritin moiety, resulting in reduced expression. By the resulting masses of the F moiety, it was estimated that proteolysis could be taking place near the HRB, bull-frog linker region of the Pre-F-NP construct. Mutations of lysine and arginine residues within this region (residues ~450-550) were explored to eliminate potential trypsin-like proteolysis of the construct. The mutations in RF8122 (SEQ ID NO: 518) relative to RF8117 (K498L and K508Q) provided improved expression in 293 cells and may reduce or eliminate proteolysis in CHO cells. Alternative mutations limited expression.

FIG. 94 summarizes modifications to RSV F nanoparticles that increased the proteolytic stability of the Pre-F-NP. The starting construct was RF8117 (above). When the earlier construct RF8085 was cloned into CHO vector as RF8090 and transfected into CHO cells, it was observed that some material was clipped between the F and ferritin moiety. It was suspected that arginine or lysine residues in the HRB region or the linker between the F and ferritin moiety were being cut by trypsin-like proteases. Mutations to lysine and arginine residues within the region were tested with respect to expression in 293 cells. FIG. 94 identifies mutations K498L and R508Q (in RF8122, SEQ ID NO: 518) as not affecting or increasing expression relative to RF8117. These mutations, with R523Q, were combined with the herein mentioned mutations of RF8117 to form construct RF8140 (SEQ ID NO: 523).

Greater improvements in expression (approximately 5-fold) were seen with the combination of single chain and proline (I217P) modifications in 293 cell expression (exemplary constructs with these substitutions include RF8106 (SEQ ID NO: 509) and RF8113 (SEQ ID NO: 516)) with further improvement in expression and solubility resulting from added glycosylation site modifications of RSV F (exemplary constructs RF8117 (SEQ ID NO: 517) and RF8140 (SEQ ID NO: 23)). These constructs all have the fusion peptide and p27 peptide regions (amino acids 98-144 of SEQ ID NO: 526) replaced with the sequence GSGNVGL (SEQ ID NO: 531). However, when RF8090 was expressed in CHO manufacturing cell lines, additional RSV F bands in western blots were observed, suggesting the construct was susceptible to proteolysis, perhaps trypsin-like cleavage at an arginine or lysine residue.

Figure 95A:
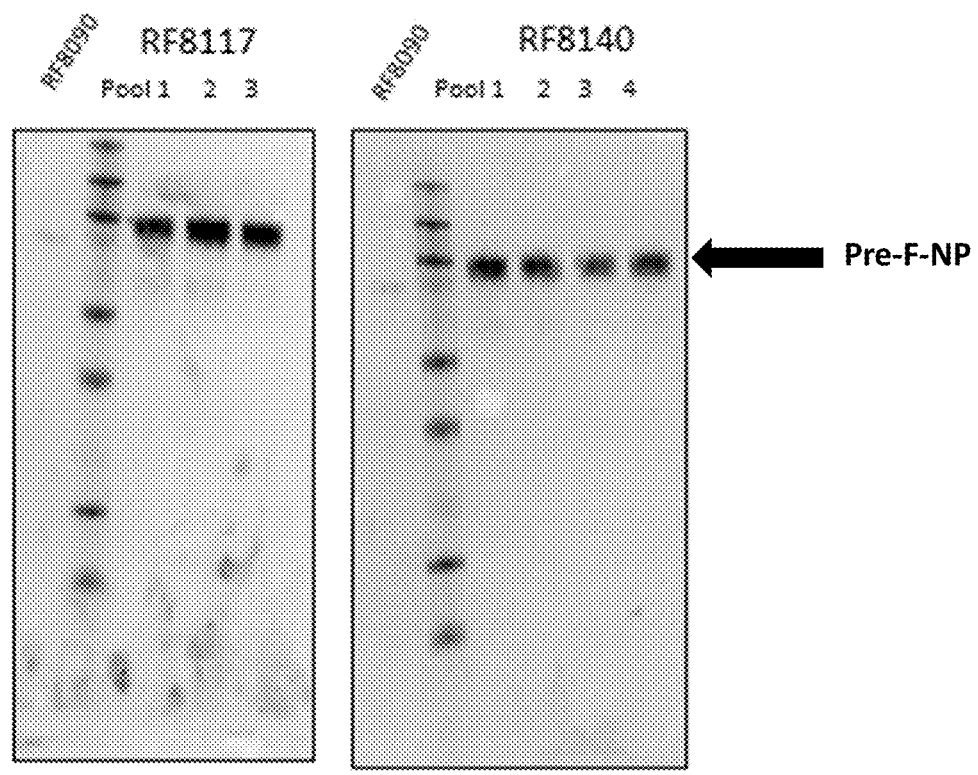
FIGS. 95A-B. Expression of RF8090, RF8117 and RF8140 in stably transfected CHO cells. Expression yield of RF8090 (SEQ ID NO: 501) was observed at low levels. Mutations to replace the disulfide of DS-CAV1 and mutations to the linker between the F moiety and ferritin moiety to eliminate potential trypsin cleavage sites were introduced as described above to constructs RF8117 (SEQ ID NO: 517) and RF8140 (SEQ ID NO: 523), which were cloned into stably expressing CHO cells.
Figure 95B:
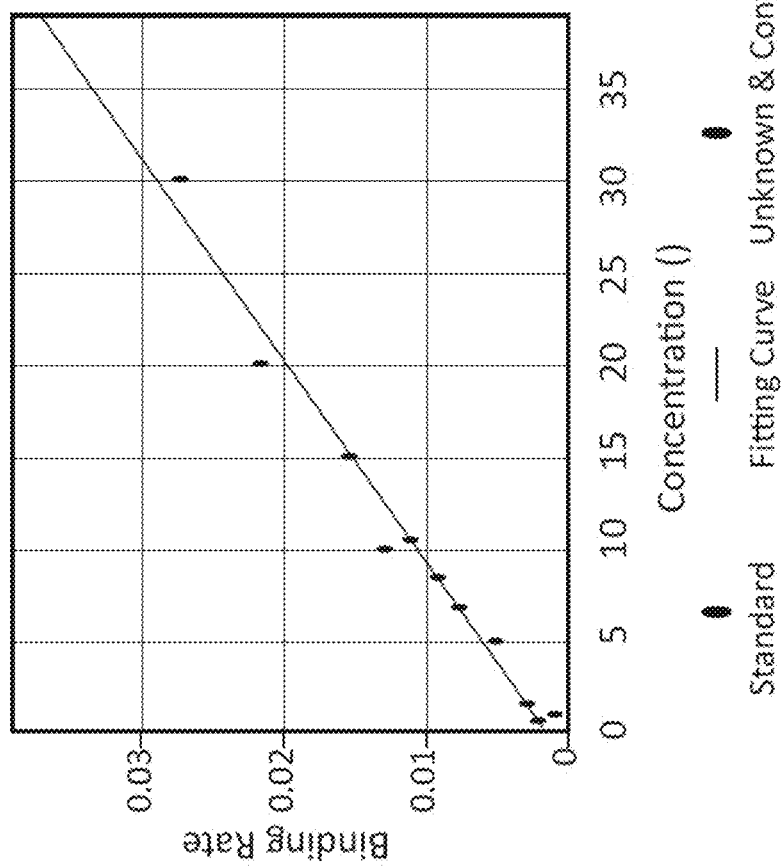

The potential role of protease susceptibility was also investigated. Substitution of K residues (knockout or KO) in the HRB region and in the linker between F moiety and ferritin moiety were made, as they were predicted to be possible sites of K-mediated cleavage initially observed in the CHO manufacturing cell line. As shown in FIGS. 95A and 95B, RF8117 and RF8140 both express to high levels relative to RF8090 in the CHO manufacturing cell line as measured by D25 Western blot or D25 and AM14 Octet analysis.

These data indicate that single chain constructs and amino acid modifications for helix capping, increasing glycosylation, and elimination of lysines or arginines susceptible to protease cleavage can improve expression of RSV F polypeptides, including RSV Pre-F-NP antigens.

Example 21: Characterization of Fusion Proteins of RSV F and Ferritin Nanoparticles Prior to animal studies, the concentration of DS-CAV1 and RSV F nanoparticles were analyzed by binding using Octet. The binding of the pre-fusion antigens to pre-fusion specific antibodies D25 and AM14 was also measured using a ForteBio Octet instrument. All assays were performed in PBS at 30° C. Antibodies were loaded onto Protein A (ProA) sensor tips (fortéBio #18-5013) for 400 seconds to allow capture to reach near saturation. Biosensor tips were then equilibrated for 90 seconds in PBS, followed by antigen association at known concentrations in PBS for 300 seconds, followed by dissociation of the antigen in PBS. Data analysis and curve fitting, assuming a 1:1 interaction, were carried out with Octet Data Analysis HT10.0 software using an external standard curve of binding of a purified Pre-F-NP at known concentration. An exemplary assay result to determine Pre-F-NP concentration in CHO conditioned media is shown in FIG. 95B.

Example 22: In Vivo Characterization of Immune Response to RSV F Polypeptides

To assess the in vivo response to RSV antigens in mice, female BALBc mice were intramuscularly immunized with RSV antigens at specified doses at week 0, 3 and 6. Unless otherwise noted, RSV antigens (e.g., in the experiments of FIGS. 96A-B and 12A-B, among others) were adjuvanted with AF03 with a bedside mixing strategy. That is, 50 µl of the relevant protein solution were mixed with 50 µl of Sanofi adjuvant AF03 (a squalene-based emulsion; see Klucker et al., J Pharm Sci. 2012 Dec; 101(12):4490-500) just prior to injection of 50 µl into each hind leg. For unadjuvanted groups, antigens were mixed as above, but the AF03 was replaced with an equivalent volume of PBS. For antigens mixed with SPA09 or Alum, the above procedure was performed replacing the AF03 with an equivalent volume of SPA09 or Alum, respectively. No adverse effects from immunization were observed for any formulation. Blood was collected 1 day prior to first immunization and at least 2 weeks after each injection (i.e. weeks 2, 5 and 8). Unless otherwise specified, data shown was for 2 weeks post third injection (week 8, also denoted as 2wp3). Typically, sera were analyzed from pre-immunized animals (denoted as naïve), two weeks post second injection (post-2 or 2wp2) or two weeks post third injection (post-$3^{rd}$ or 2wp3).

For the Vero cell neutralizing assay, serum was heat-inactivated for 30 minutes at 56° C. A four-fold serial dilution series of the inactivated serum was made in Dulbecco's Modified Eagle Medium (DMEM) supplemented with 2% Fetal Bovine Serum (FBS), 1% GlutaMAX, and 1% antibiotic-antimitotic. RSV viral stocks were combined 1:1 with the serum dilutions and incubated for 1.5 hours at 37° C. The virus-serum mixture was then added to 24 well plates containing confluent Vero cell monolayers at 100 µL per well and incubated for 1.5 hours at 37° C., 5% $CO_2$. The inoculum was then overlaid with 1 mL per well of 0.75% Methyl cellulose in DMEM supplemented with 2% FBS and 2% GlutaMAX and 2% antibiotic-antimitotic. Following 5 days of incubation at 37° C., 5% CO2, the overlay was removed and the monolayers were fixed with ice-cold methanol for 20 minutes.

The plates were then washed once in water and blocked with 5% non-fat dry milk in Phosphate Buffered Saline (PBS) for 30 minutes at room temperature with gentle agitation. The blocking solution was then replaced with 200 µL per well of 2% dry milk in PBS containing a 1:2000 dilution of anti-RSV antibody conjugated to horse radish peroxidase (Abcam AB20686). Following 3 hours of incubation at room temperature, the plates were washed 2 times with water, developed with TrueBlue HRP substrate, washed twice more in water and air-dried.

The stained plaques were counted using a dissecting microscope. The neutralizing antibody titers were determined at the 60% reduction end-point of mock neutralized virus controls using the formula: 60% plaque reduction titer=(C/V×0.4−Low)/(High−Low)×(HSD−LSD)+LSD, where C/V=average of RSV plaques in mock neutralized virus control wells, Low and High are the average number of RSV plaques in the two dilutions which bracket the C/V×0.4 value for a serum sample, and the HSD and LSD are the Higher and Lower Serum Dilutions.

For the HAE neutralizing assay, serum was heat-inactivated for 30 minutes at 56° C. A fourfold serial dilution series of the inactivated serum was made in PneumaCult™-ALI Basal Medium (Stem Cell Technologies; 05002) supplemented with PneumaCult™-ALI 10× Supplement (Stem Cell Technologies; 05003) and 1% Antibiotic/Antimycotic (hence media). RSV viral stocks were combined 1:1 with the serum dilutions and incubated for 1.5 hours at 37° C. The virus-serum mixture was then added to 24 well plates containing fully differentiated HAE cells at 50 µL per well and incubated for 1.5 hours at 37° C., 5% $CO_2$. Following incubation, the inoculum was removed, the wells were washed twice with media to remove unbound virus and incubated a further 20 hours at 37° C., 5% $CO_2$. Infection events in cultures infected with RSV expressing the mKate (TagFP635) reporter were counted on a fluorescent microscope.

To detect infection with RSV not expressing the mKate reporter, the pseudostratified epithelia were washed extensively with media to remove mucus then fixed with 4% paraformaldehyde for 30 minutes at room temperature, permeabilized with 0.25% Triton X-100 for 30 minutes, and blocked with DMEM supplemented with 2% FBS for 1 hour at 37° C. The blocking solution was replaced with 100 µL per well of Mouse Anti-RSV monoclonal Ab mixture (Millipore; MAB 858-4) diluted 1:200 in DMEM supplemented with 2% FBS, and the plates were incubated at 37° C. for 2 hours. The plates were then washed 3 times with PBS supplemented with 0.05% Tween 20. 100 µL of Goat anti-mouse IgG (H+L) (Invitrogen; A11001) diluted 1:200 in DMEM supplemented with 2% FBS was added per well, and the plates were incubated overnight at 4° C. Next morning, the plates were washed 3 times with PBS supplemented with 0.05% Tween 20, the florescent signal was stabilized with ProLong Gold AntiFade with DAPI (Thermo Fisher Scientific; P36935) and counted on a fluorescent microscope. The neutralizing antibody titers were determined at the 60% reduction end-point as above.

For anti-F binding, either pre-fusion F (DS-CAV1) or post-fusion F were bound to anti-HIS antibody tips on the Octet. Unless specified, all anti-F binding refers to anti-prefusion F trimer (DS-CAV1) binding. $His_6$-tagged (SEQ ID NO: 442) RSV F trimer (DS-CAV1 or Post-fusion F were pre-loaded onto Anti-Penta-HIS (HIS1K) sensor tips (FortéBio #18-5122) for 400 seconds to allow capture to reach near saturation. Biosensor tips were then equilibrated for 90 seconds in Octet Wash Buffer, followed by diluted sera association for 300 seconds. Association curve final responses were measured using Octet Data Analysis HT10.0 software, and the response was multiplied by the dilution factor (100 or 300) to obtain the final reported response.

For anti-Gcc binding, a trimerized dimer of Gcc peptide with a C-terminal HIS tag was used on an Octet tip similar to above. $His_6$-tagged (SEQ ID NO: 442) Gcc (A2 strain) hexamer was pre-loaded onto Anti-Penta-HIS (HIS1K) sensor tips (FortéBio #18-5122) for 400 seconds to allow capture to reach near saturation. Biosensor tips were then equilibrated for 90 seconds in Octet Wash Buffer, followed by diluted sera association for 300 seconds. Association curve final responses were measured using Octet Data Analysis HT10.0 software, and the response was multiplied by the dilution factor (100 or 300) to obtain the final reported response.

For non-human primate (NHP) studies, NHPs were pre-screened for RSV response (baselines were found to be below detection limits for all assays). NHPs were immunized with 50 µg of RF8140 with denoted adjuvant similar to the mouse protocol above but with larger volume of adjuvant (FIGS. 97C-D and FIG. 104).

For non-human primate study, VERO neutralization assays were performed as described above. Pre-F-binding was assessed by ELISA assay below.

The NHP serum samples were serially diluted 2-fold (initial dilution 1:100) and incubated on blocked RSV soluble F (Sinobiological #11049-V08B) coated plates (1 µg/mL, 100 µL/well) for 1 h at 37° C. RSV F-specific IgGs were detected using horseradish peroxidase-conjugated anti-monkey IgG (BioRad AAI42P, 1:10,000 dilution) for 90 minutes at 37° C. Plates were developed using 3, 3', 5, 5'-tetramethylbenzidine (TMB Tebu-Bio) and stopped with 1 N hydrochloric acid (Prolabo #30024290). The optical density (OD) was measured at 450 nm-650 nm with a microplate reader (SpectraMax). RSV sF-specific IgG titers were calculated using the SoftmaxPro software, for the OD value range of 0.2 to 3.0, from the titration curve (standard mouse hyper-immune serum put on each plate).

The IgG titers of this reference, expressed in arbitrary ELISA units (EU), corresponded to the log 10 of the reciprocal dilution giving an OD of 1.0. The threshold of antibody detection was 20 (1.3 log 10) EU. All final titers were expressed in log 10 for graphing. To each titer <1.3 log 10, an arbitrary titer of 1.0 log 10 was assigned.

To assess the cell mediated immunity in the NHP study, IFNγ/IL-2 FluoroSpot kit (FS-2122-10, Mabtech) was used following manufacturer's instructions. Briefly, membrane of the IPFL plates were pre-wet with 35% ethanol and the capture antibodies (anti-IFNγ and anti-IL-2) were coated overnight at 4° C.

Plates were then blocked for 2 hours at 37° C. with 200 µL/well of cell incubation medium containing 10% fetal calf serum (FCS). The medium was removed and the stimuli added in the wells: full-length F antigen (antigen-specific stimulation), anti-CD3 (positive control) or cell culture medium (unstimulated control). Macaque Peripheral Blood Mononuclear Cells (PBMCs) were thawed and numerated. 400,000 cells were added per well and incubated for 24 h at 37° C. in a humidified incubator with 5% CO2.

For detection the cells were removed and the detection antibodies (conjugated anti-IFNγ and anti-IL-2) were added and incubated 2 h at room temperature. The fluorophore-conjugated reagents were then added and incubated 1 h at RT. Plates were empty, dried and stored in the dark at RT until analysis. Anti-CD3 mAb was used as positive control and responses of >500 Spot Forming Counts (SFC)/million PBMCs were found in all samples, verifying acceptable sample quality. Spots detected in the non-stimulated wells (cell culture medium) were subtracted to F-antigen stimulated cells.

For the human cell (or B-cell) analysis, experiments were performed similar to referenced experiment Dauner, et al. Vaccine 2017 Oct. 4; 35(41):5487-5494 (FIG. 106). Cells were either not treated (treated with PBS) or treated with RSV F or RSV G polypeptides as denoted at 100 ng doses. F-binding and G-binding responses were performed using the luminex assay described in the literature with beads coated with pre-F-trimer (DS-CAV1) or G ectodomain, respectively.

Figure 96A:
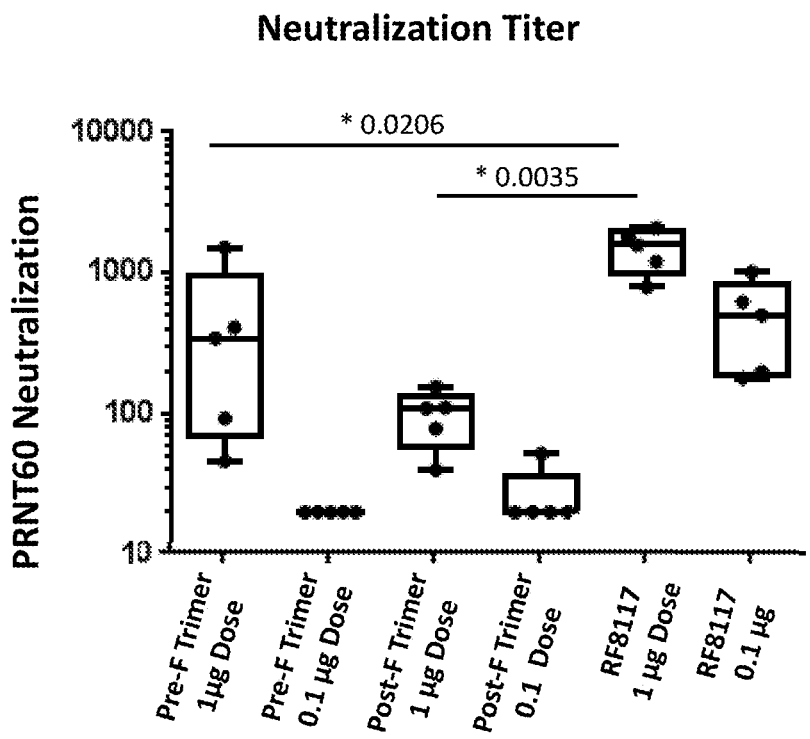
FIGS. 96A-B. Neutralizing antibody response to Pre-F-NP RF8117.

RF8117 (SEQ ID NO: 517) comprises engineered glycosylation sites at E328N, S348N and R507N, which as mentioned above do not prevent D25 or AM14 binding. To demonstrate this pre-fusion nanoparticle elicits a similar immune response to other pre-fusion antigens (DS-CAV1) we immunized mice in groups of 5 with either pre-F trimer (DS-CAV1), post-fusion F or RF8117 at 1 μg or 0.1 μg doses, all adjuvanted with AF03, three times with three weeks between injections. Sera was tested for neutralizing titer two weeks after the third immunization using the VERO cell assay. RF8117 at the higher dose elicited a neutralizing titer similar to the pre-fusion control, and superior to the post-fusion control. At the lower dose, RF8117 elicited a higher neutralizing titer than both pre-fusion control and post-fusion control (FIG. 96A).

Figure 96B:
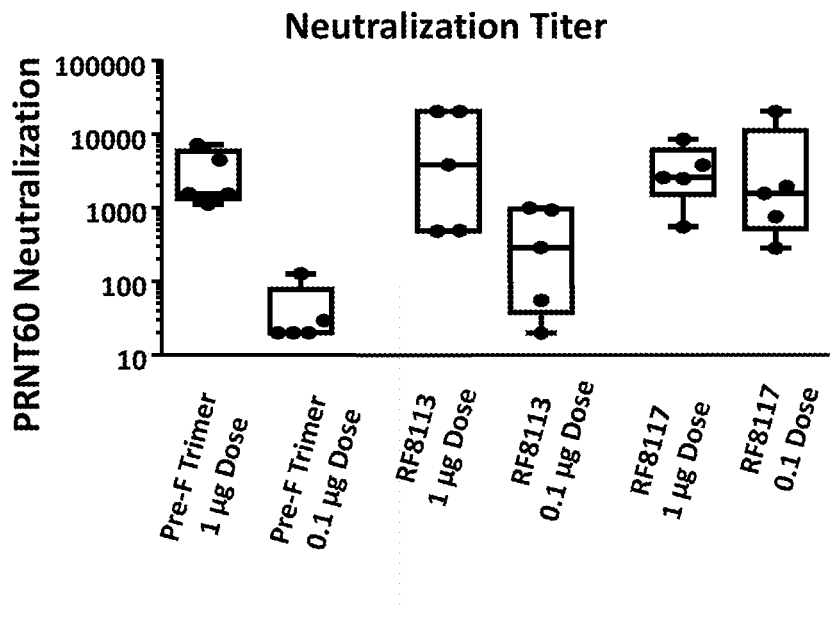

The RSV Pre-F-NP harbors glycosylation sites engineered to block epitopes shared between the pre-fusion and post-fusion confirmation. Whether these glycans were inhibiting the neutralizing response was evaluated. RF8117, with engineered glycans (SEQ ID NO: 517), was compared to RF8113 (similar to RF8117 but lacking the engineered glycans; SEQ ID NO: 516) and pre-fusion trimer control (DS-CAV1). Mice in groups of 5 were immunized with 1 μg or 0.1 μg doses, all adjuvanted with AF03, three times with three weeks between injections. Sera was tested for neutralizing titer two weeks after the third immunization using the VERO cell assay. There was no significant difference at either dose between the RF8113 and RF8117 constructs as judged by neutralizing titer (FIG. 96B).

Figure 97A:
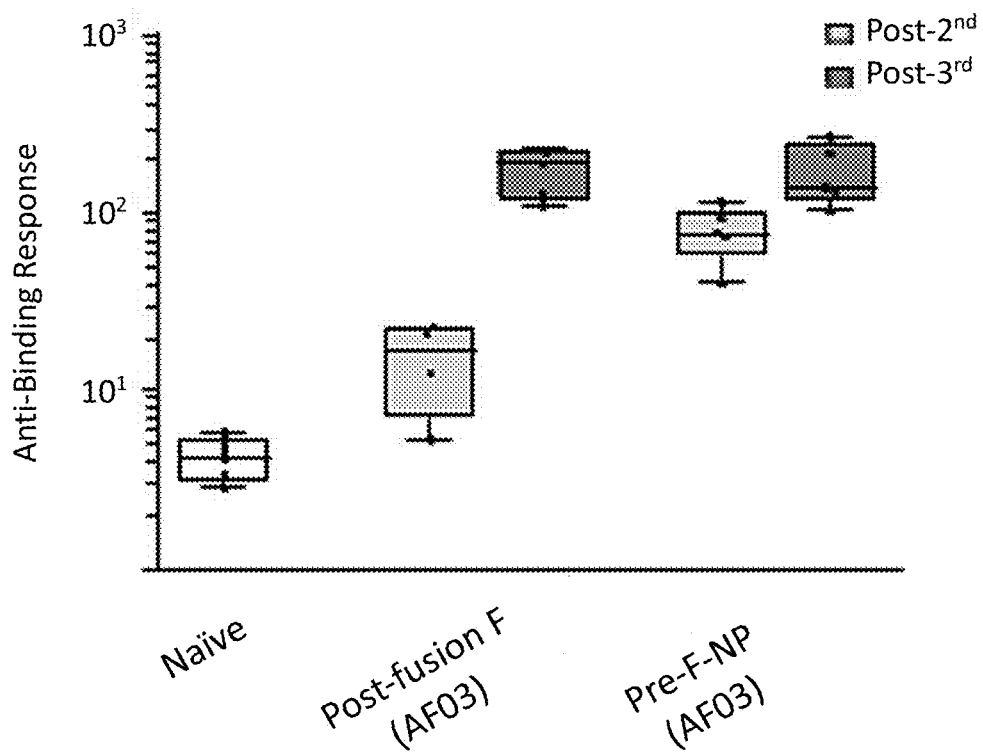
FIG. 97A-D. Comparison of RSV pre-fusion F trimer (DS-CAV1) binding antibody and RSV neutralizing antibodies elicited by immunization with post-fusion F trimer (SEQ ID NO: 524) or Pre-F-NP (RF8140 SEQ ID NO: 523) in mouse or non-human primate models.
Figure 97B:
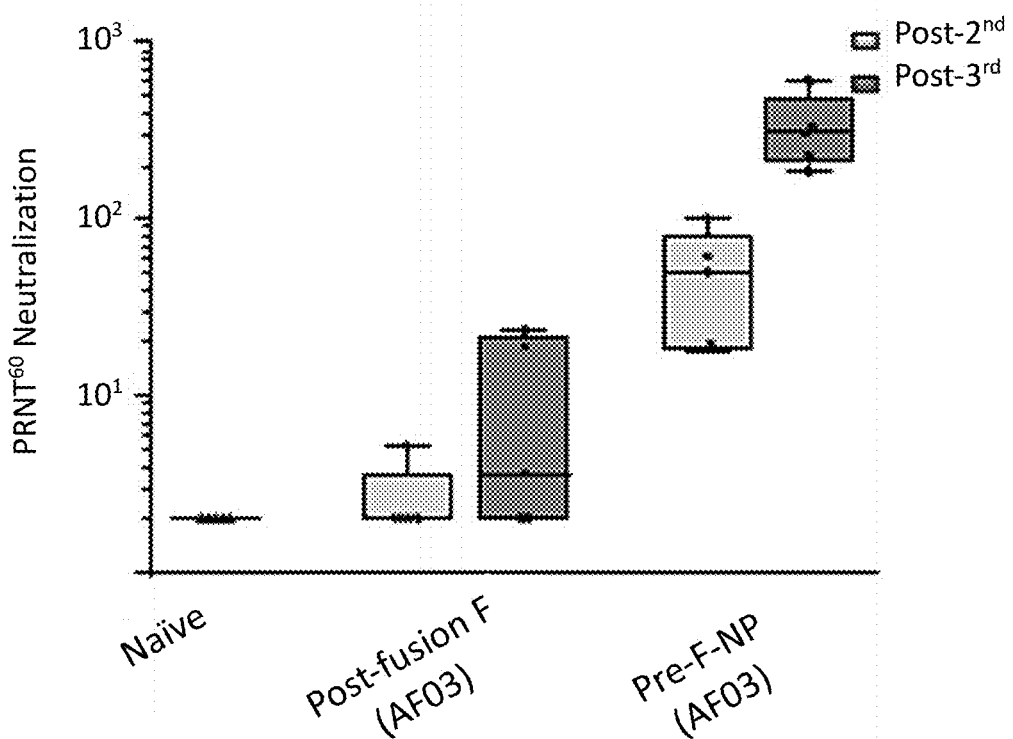
Figure 97C:
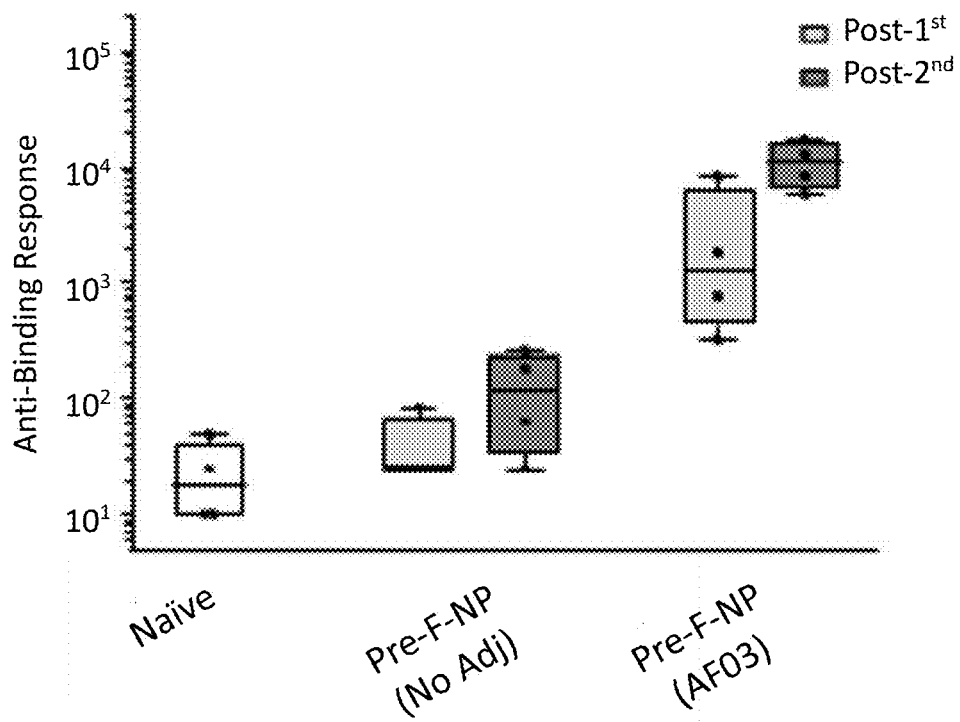
Figure 97D:
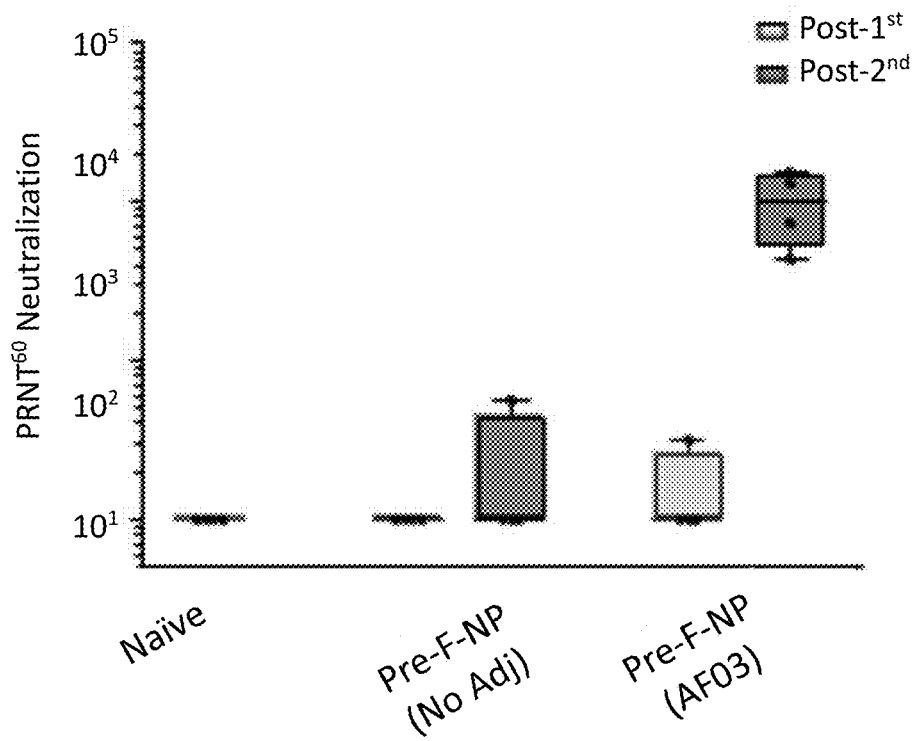

To demonstrate that the herein mentioned lysine and arginine knockouts of RF8140 (SEQ ID NO: 523) do not upset the ability of the antigen to elicit a neutralizing response, we compared the immunogenicity of RF8140 (SEQ ID NO: 525) to that of post-fusion F trimer (SEQ ID NO: 524) in mice (FIGS. 97A&B). At low dose (0.1 μg) RF8140 (SEQ ID NO: 525) elicits a superior neutralizing titer to post-fusion trimer (SEQ ID NO: 524). To demonstrate RF8140 (SEQ ID NO: 523) elicits an immune response in NHPs, we immunized NHPs with RF8140 (SEQ ID NO: 525) with or without adjuvant (AF03). FIG. 97C shows the RSV F-binding response (ELISA titer) while FIG. 97D compares RSV neutralizing titers elicited by immunization with Pre-F-NP (RF8140, SEQ ID NO: 523). Both unadjuvanted and adjuvanted RF8140 (SEQ ID NO: 525) elicit an immune response in NHPs.

Having shown the engineered glycosylation sites of RF8117 (SEQ ID NO: 517) and RF8140 (SEQ ID NO: 523) do not prevent these antigens from eliciting a neutralizing response, we wanted to demonstrate they do block non- or poorly neutralizing epitopes shared between the pre-fusion and post-fusion conformation (FIG. 98). Antibody response to Pre-fusion F (DS-CAV1, SEQ ID NO: 525) elicited by immunization with Pre-F-NP without engineered glycosylation (RF8113, SEQ ID NO: 516) or Pre-F-NP with engineered glycosylation (Engineered Gly Particle, RF8117 SEQ ID NO: 517) at high (1 μg) and low (0.1 μg) dose as measured by Octet (FIG. 98A). Responses elicited by either Pre-F-NP were similar. Antibody response to post-fusion trimer elicited by immunization with Pre-F-NP without engineered glycosylation (RF8113, SEQ ID NO: 516) or Pre-F-NP with engineered glycosylation (RF8117, SEQ ID NO: 517) at high (1 μg) and low (0.1 μg) dose as measured by Octet (FIG. 98B). The post-fusion F-binding responses elicited by RF8117 (SEQ ID NO: 517) were significantly lower than those elicited by RF8113 (SEQ ID NO: 516). Therefore, while both RF8113 and RF8117 elicit robust antibody responses to pre-fusion F, the post-fusion F antibody response elicited by RF8117 is greatly repressed. This is due to the engineered glycans mapping to the shared pre-fusion and post-fusion epitopes (FIG. 88B).

Figure 99A:
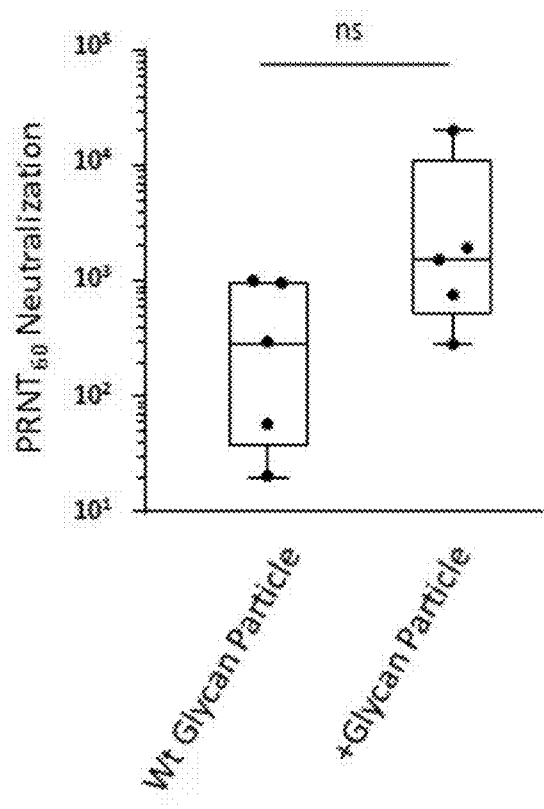
FIGS. 99A-C show blocking of non-neutralizing epitopes by engineered glycosylation sites.
Figure 99B:
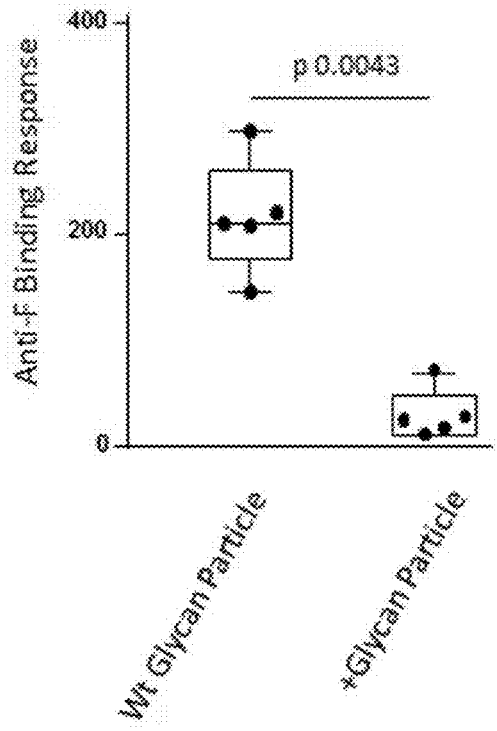
Figure 99C:
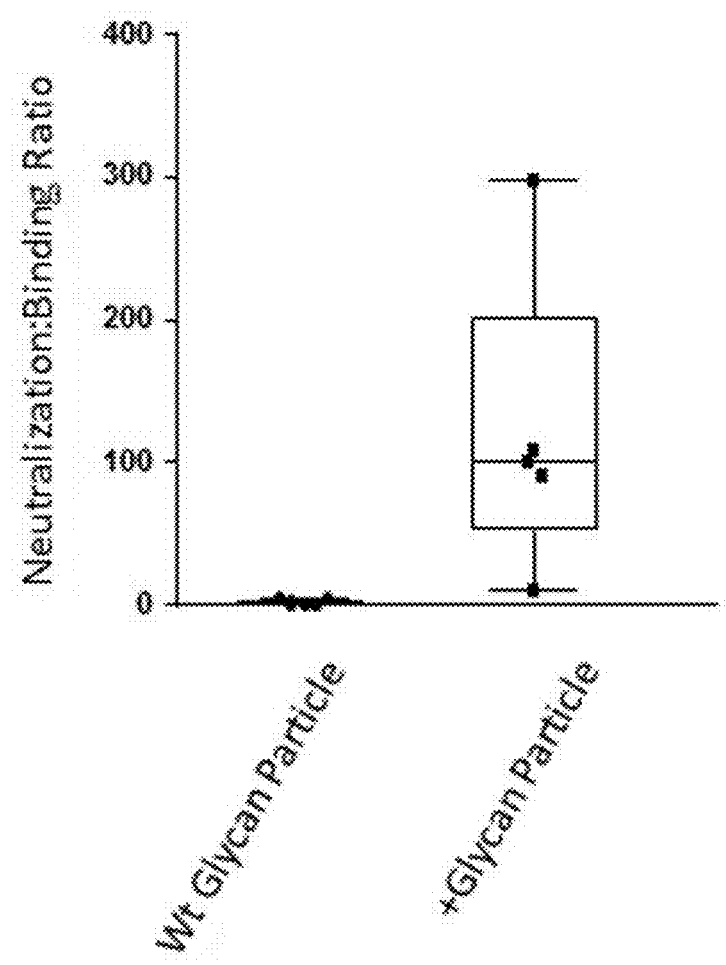

To further demonstrate that the engineered glycosylation sites block non-neutralizing epitopes but bias the neutralizing to non-neutralizing antibody titer, we analyzed the above data in a different way (FIG. 99A-C). Comparison of RSV neutralizing titers as measured by VERO cell assay elicited by immunization with Pre-F NP with wild-type glycosylation sites (Wt Glycan Particle; RF8113, SEQ ID NO: 516) versus Pre-F NP with additional engineered glycosylation sites (+Glycan Particle; RF8117, SEQ ID NO: 517) in mouse studies were measured and showed no significant difference (FIG. 99A). Comparison of RSV Post-fusion F trimer-binding antibody responses elicited by immunization with Wt Glycan Particle (RF8113, SEQ ID NO: 516) versus +Glycan Particle (RF8117, SEQ ID NO: 517) in mouse studies showed a repressed post-fusion F-binding response for the Pre-F-NP with engineered glycans (FIG. 99B). To demonstrate that engineered glycans do not reduce the functional, neutralizing antibody response but decrease the non-neutralizing antibodies elicited to the shared pre-fusion/post-fusion epitopes, thus improving the neutralizing to total antibody ratio elicited by the engineered glycan constructs, the ratio of neutralizing titer to F-binding response was plotted (FIG. 99C). Therefore, the Pre-F-NPs with the engineered glycans elicit a superior neutralizing to binding antibody profile in mouse studies.

Figure 100A:
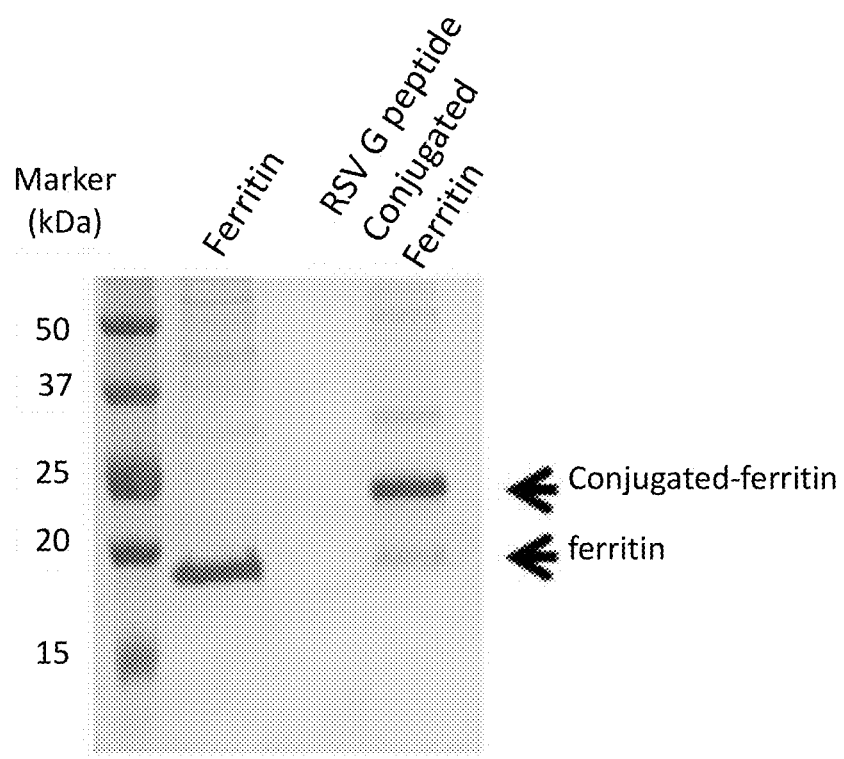
FIG. 100A-D. Characterization of RSV G central domain peptide (Gcc) conjugated to ferritin nanoparticle.
Figure 100B:
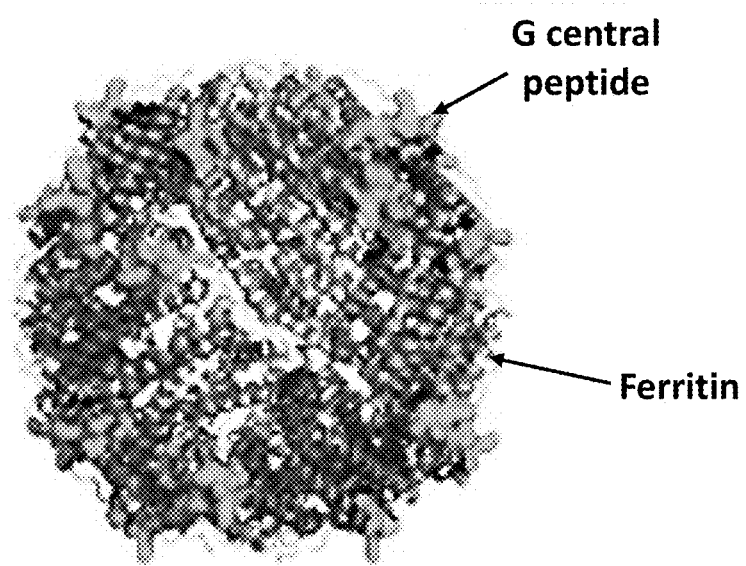

To demonstrate the ferritin nanoparticle can be used to improve the immunogenicity of the RSV G central domain antigen we developed a method of chemically conjugating the Gcc peptide (SEQ ID NO: 529) to the ferritin nanoparticle. Ferritin harboring the S111C mutation described herein can be conjugated with the Gcc peptide (SEQ ID NO: 529) synthesized with a maleimide group on a PEG4 linker attached to the N-terminus via a NHS group. Gcc peptide with an N-terminal maleimide was synthesized and HPLC purified by Peptides International (Louisville, KY, USA). When the maleimide-Gcc antigen is added to the ferritin S111C particle, the maleimide conjugates to the free cysteine and forms a Gcc-NP that can be observed by Coomassie-stained SDS-PAGE gel (FIG. 100A). While the conjugation is typically 50% to 90% efficient, a model of a Gcc peptide ferritin nanoparticle (100% conjugated) is shown in FIG. 100B.

Figure 100C:
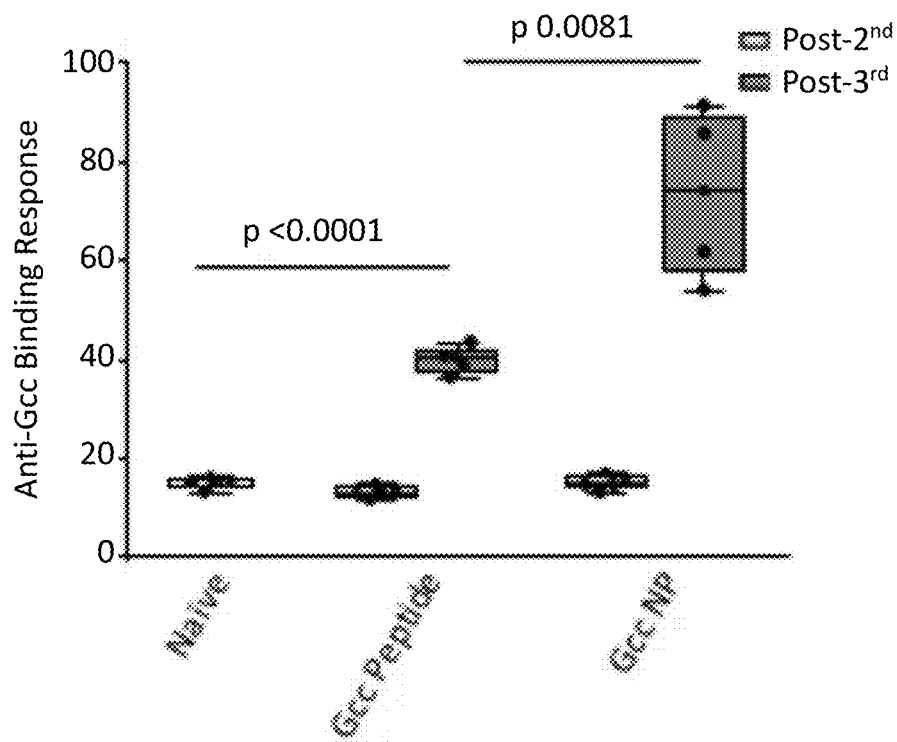
Figure 100D:
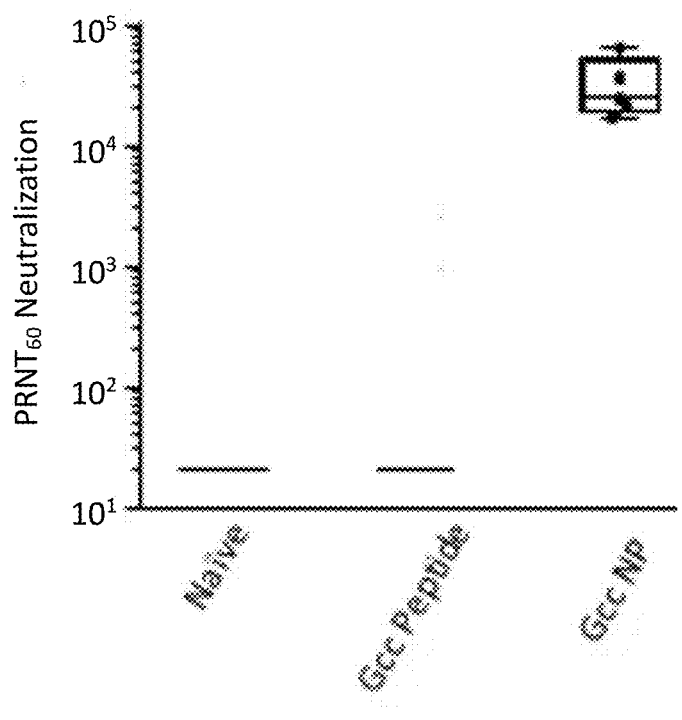

To determine if the Gcc-NP elicits an immune response superior to the Gcc peptide (SEQ ID NO: 529), 5 mice per group were immunized with either Gcc peptide or Gcc-NP (1.3 μg dose mixed 1:1 with RIBI for each immunization). The Gcc-binding response (Octet) at two weeks post-second and two weeks post-third immunizations was compared to a representative group of naïve mice sera (FIG. 100C). The neutralizing response elicited by immunization with Gcc peptide (SEQ ID NO. 529) versus Gcc-NP in mouse studies post-third injection was also compared in HAE neutralizing assays (FIG. 100D). Gcc-NP elicits a superior immune response than Gcc peptide alone as judged by both Gcc-binding response and neutralizing response.

Figure 101A:
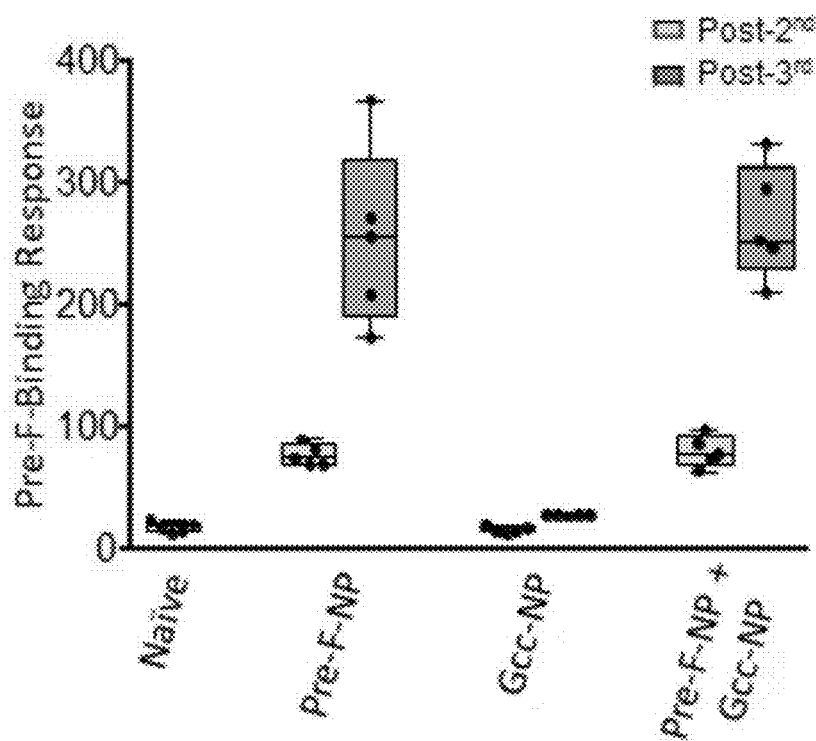
FIGS. 101A-C. Co-administration of RSV Pre-F-NP (RF8140) and Gcc-NP elicit a neutralizing response. Mice were immunized with Pre-F-NP (RF8140) alone, Gcc-NP alone, or Pre-F-NP and Gcc-NP combined at 1 µg dose per antigen. All immunizations were adjuvanted with AF03 as above.
Figure 101B:
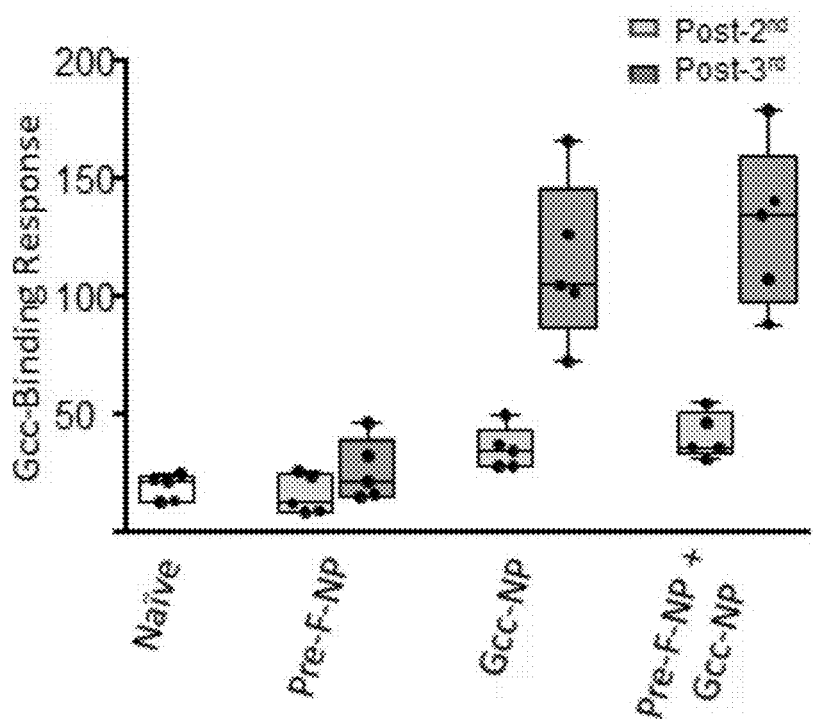
Figure 101C:
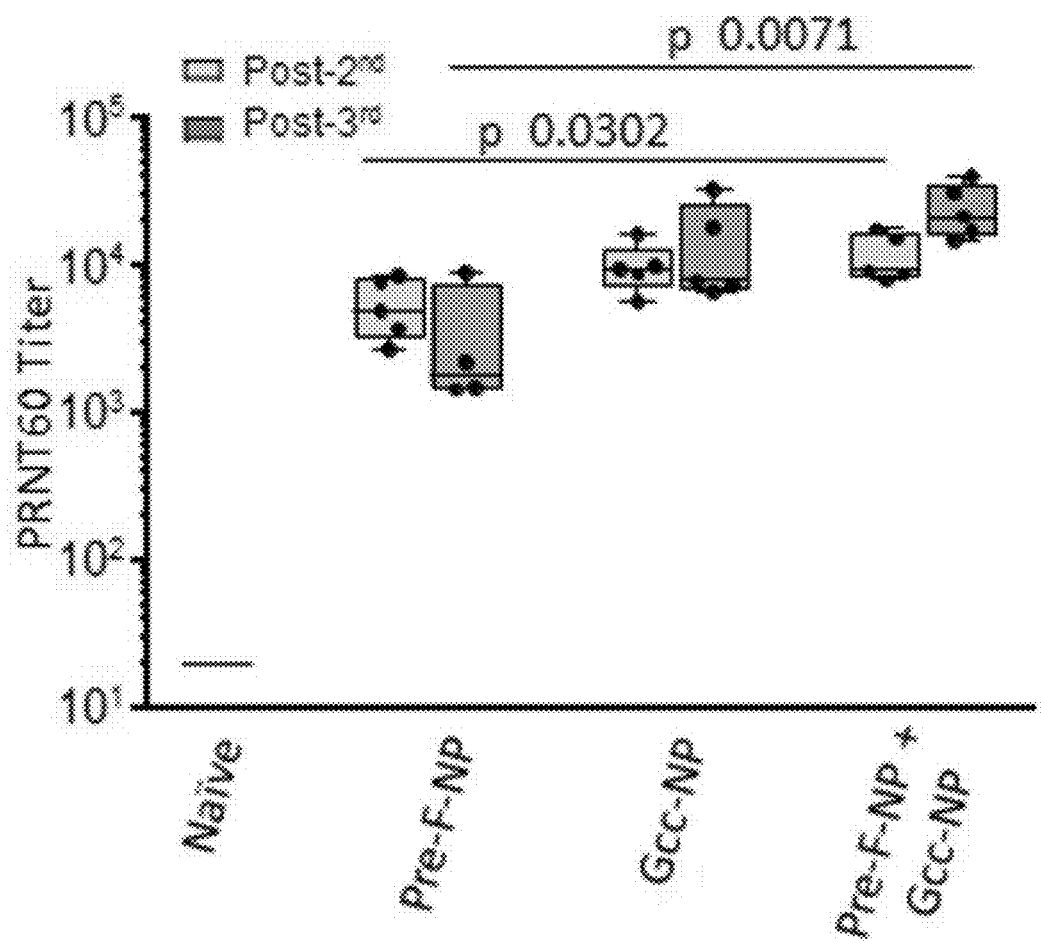

To demonstrate that co-administration of RSV Pre-F-NP (RF8140) and Gcc-NP does not interfere with either antigen's ability to elicit an immune response, mice were immunized with either Pre-F-NP alone (RF8140, SEQ ID NO: 523), Gcc-NP (ferritin conjugated with Gcc peptide SEQ ID NO: 529), or Pre-F-NP (RF8140, SEQ ID NO: 523) combined with Gcc-NP (FIG. 101A-C). All immunizations were adjuvanted with AF03. Mice immunized with RF8140 alone (Pre-F-NP) or RF8140 and Gcc-NP (Pre-F-NP+Gcc-NP) developed antibodies that bind pre-fusion F trimer (DS-CAV1, SEQ ID NO: 525) while mice immunized with Gcc-NP did not. Mice immunized with Gcc-NP alone (Gcc-NP) or RF8140 and Gcc-NP developed antibodies that bind Gcc peptide, while mice immunized with just RF8140 did not. Animals immunized with either Pre-F-NP alone, Gcc-NP alone, or the co-administration of Pre-F-NP and Gcc-NP all developed a neutralizing response post-second and post-third immunization as measured by HAE neutralizing assay.

Figure 102B:
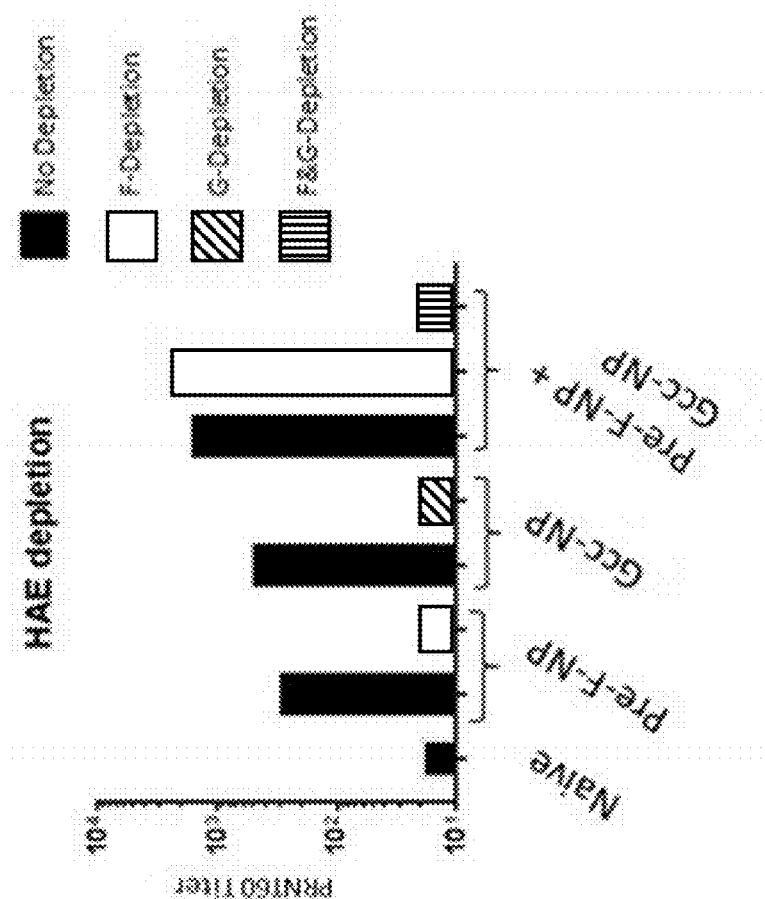
FIG. 102A-B. Co-administration of Pre-F-NP and Gcc-NP does not interfere with elicitation of antibodies that bind Pre-fusion F trimer or Gcc-nanoparticle. Neutralizing titers measured by the F-sensitive VERO cell assay are on the left in FIG. 102A, while neutralizing titers measured by the F- and G-sensitive HAE assay are shown on the right in FIG. 102B. Animal immunizations were as in FIG. 101. RSV polypeptides used in the immunization are below the horizontal axis. The black bars represent sera pooled from the immunization groups described in FIG. 101 and are similarly labeled. Sera from naïve animals are also shown as black bars and labeled for comparison. Sera depleted with pre-fusion F trimer are in white, just to the right of the corresponding black bar. Sera depleted with G ectodomain are in diagonally striped bars, just to the right of the corresponding black bar. Sera depleted with pre-fusion F trimer followed by depletion with G ectodomain is in a vertically striped bar.
Figure 102A:
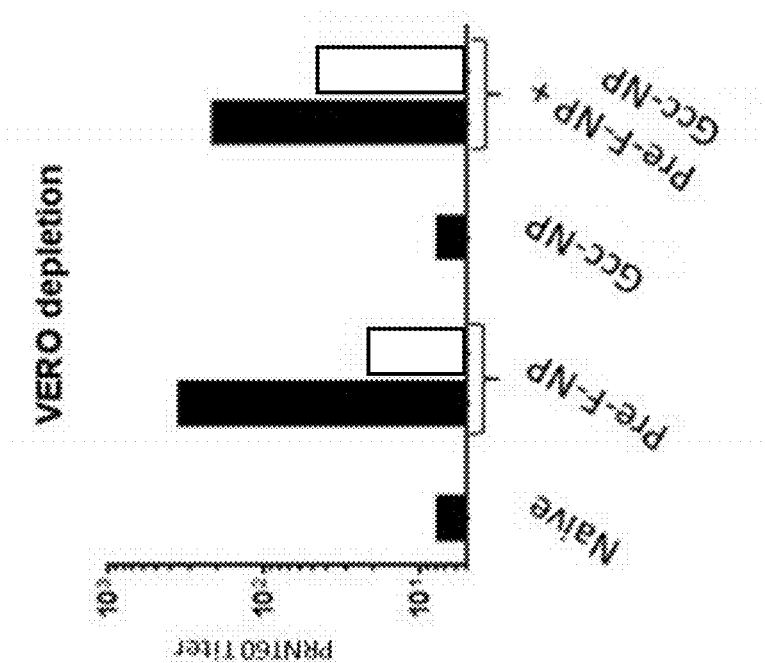

To determine if co-administration of RSV Pre-F-NP and Gcc-NP interfered with either antigen's ability to elicit neutralizing antibodies, neutralizing antibodies to both F and G were studied in a depletion assay (FIG. 102A-B). To demonstrate that the addition of Gcc-NP does not interfere with Pre-F-NP's ability to elicit a neutralizing response, the neutralizing titers were measured by the F-sensitive VERO cell assay for the groups mentioned above (FIG. 102A). Sera from naïve animals were also tested to judge the quality of the antigen depletions. In the VERO assay, sera from mice immunized with either RF8140 (SEQ ID NO: 523) alone or RF8140 mixed with Gcc-NP elicited similar neutralizing responses, while Gcc-NP did not appear to elicit neutralizing response in the F-antibody sensitive VERO assay. When antibodies that bind pre-fusion trimer (DS-CAV1, SEQ ID NO: 525) were depleted from pooled sera from animals immunized with RF8140 (SEQ ID NO: 523) alone or immunized with RF8140 (SEQ ID NO: 523) and Gcc-NP, a reduction in the measurable neutralizing titers was observed in the VERO assay. When the above groups were measured for neutralizing titer in the HAE cell assay, all immunization groups were observed to develop a neutralizing response in the F- and G-sensitive assay (FIG. 102B). Pooled sera from animals immunized with RF8140 (SEQ ID NO: 523) alone elicited a neutralizing response in the HAE assay that could be depleted out with pre-fusion F trimer (DS-CAV1, SEQ ID NO: 525). Pooled sera from animal immunized with Gcc-NP alone elicited a neutralizing response in the HAE assay that could be depleted out with G ectodomain (SEQ ID NO: 528). Pooled sera from animals immunized with both Pre-F-NP (RF8140, SEQ ID NO: 523) and Gcc-NP elicited a neutralizing response in the HAE assay that was not fully depleted by DS-CAV1 (SEQ ID NO: 525) but was fully depleted by subsequent depletions with DS-CAV1 then G ectodomain (SEQ ID NO: 528). Together, these data suggest co-administration with the Pre-F-NP and Gcc-NP does not interfere with either antigen's ability to elicit neutralizing antibodies to pre-fusion F or G, respectively.

Figure 103B:
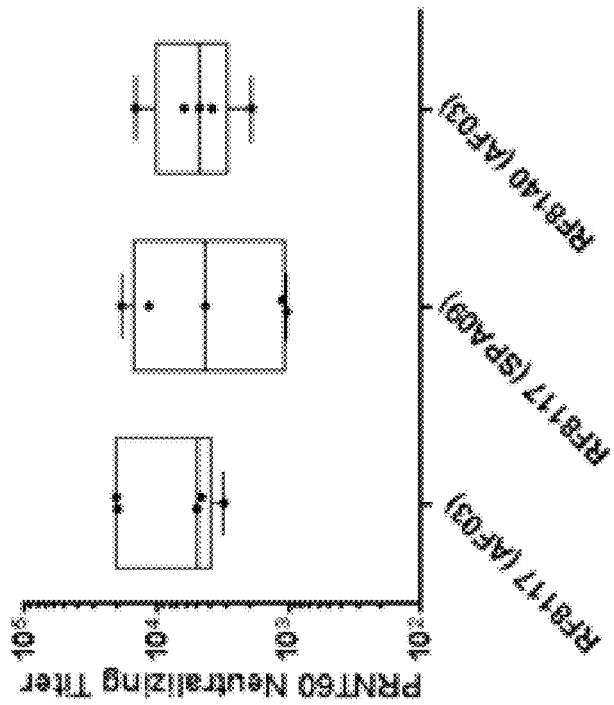
FIGS. 103A-B. Adjuvanting RF8117 or RF8140 with AF03, SPA09 or Alum elicits a superior neutralizing response in mice relative to unadjuvanted RF8117.
Figure 103A:
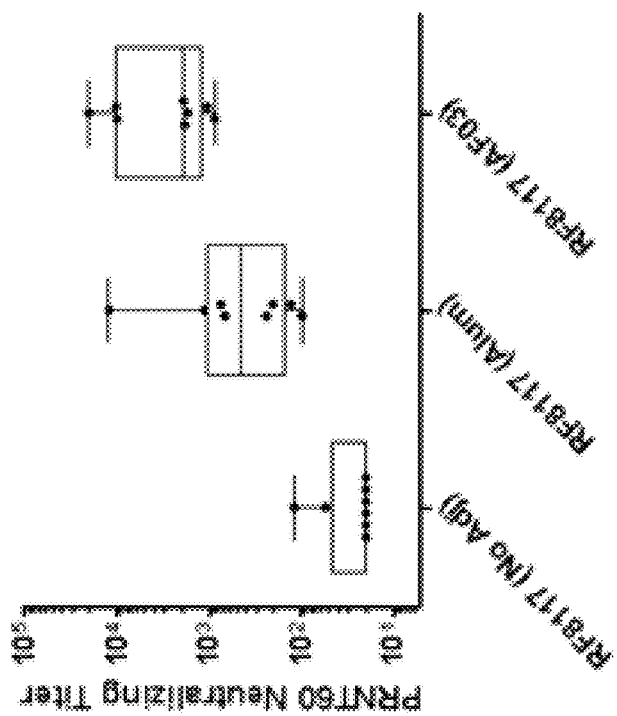

To demonstrate the effect of adjuvanting RF8117 (SEQ ID NO: 517) or RF8140 (SEQ ID NO: 523), mice were dosed with these constructs mixed with AF03, SPA09 or Alum. In FIG. 103A, mice were immunized with 10 μg antigen mixed with adjuvant, while in FIG. 103B, mice were immunized with 1 μg antigen mixed with adjuvant. In FIG. 103A, neutralizing titers measured by VERO cell assay at the two week post-third immunization timepoint. Sera from mice immunized with RF8117 (SEQ ID NO: 517) either unadjuvanted (No Adj), adjuvanted with Alum, or adjuvanted with AF03 are shown. In FIG. 103B, neutralizing titers were measured by VERO cell assay for sera from mice immunized with RF8117 (SEQ ID NO: 517) adjuvanted with AF03, RF8117 (SEQ ID NO: 517) adjuvanted with SPA09, or RF8140 adjuvanted with AF03. In all cases for either RF8117 (SEQ ID NO: 517) or RF8140 (SEQ ID NO: 523), in naïve mice adjuvanted groups elicit a higher neutralizing titer than non-adjuvanted groups. Mice immunized with RF8117 (SEQ ID NO: 517) or RF8140 (SEQ ID NO: 523) mixed with AF03 elicited a similar neutralizing response, suggesting the added lysine and arginine mutations of RF8140 (SEQ ID NO: 523) do not interfere with the Pre-F-NP's ability to elicit a neutralizing response.

Figure 104A:
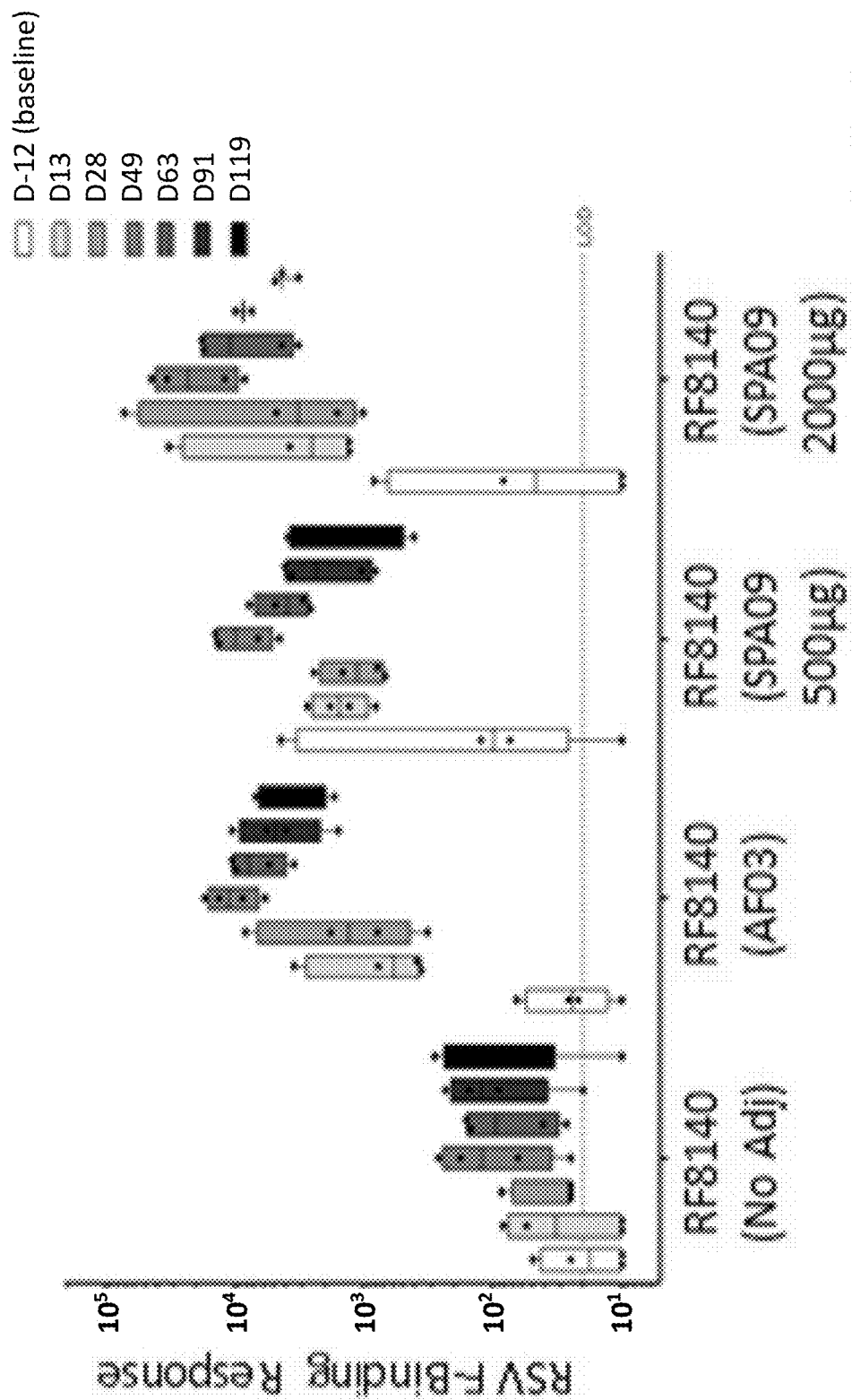
FIGS. 104A-B. Adjuvanting RF8140 with AF03 or SPA09 elicits a superior neutralizing response in non-human primates (NHPs) relative to unadjuvanted RF8140 immunizations.
Figure 104B:
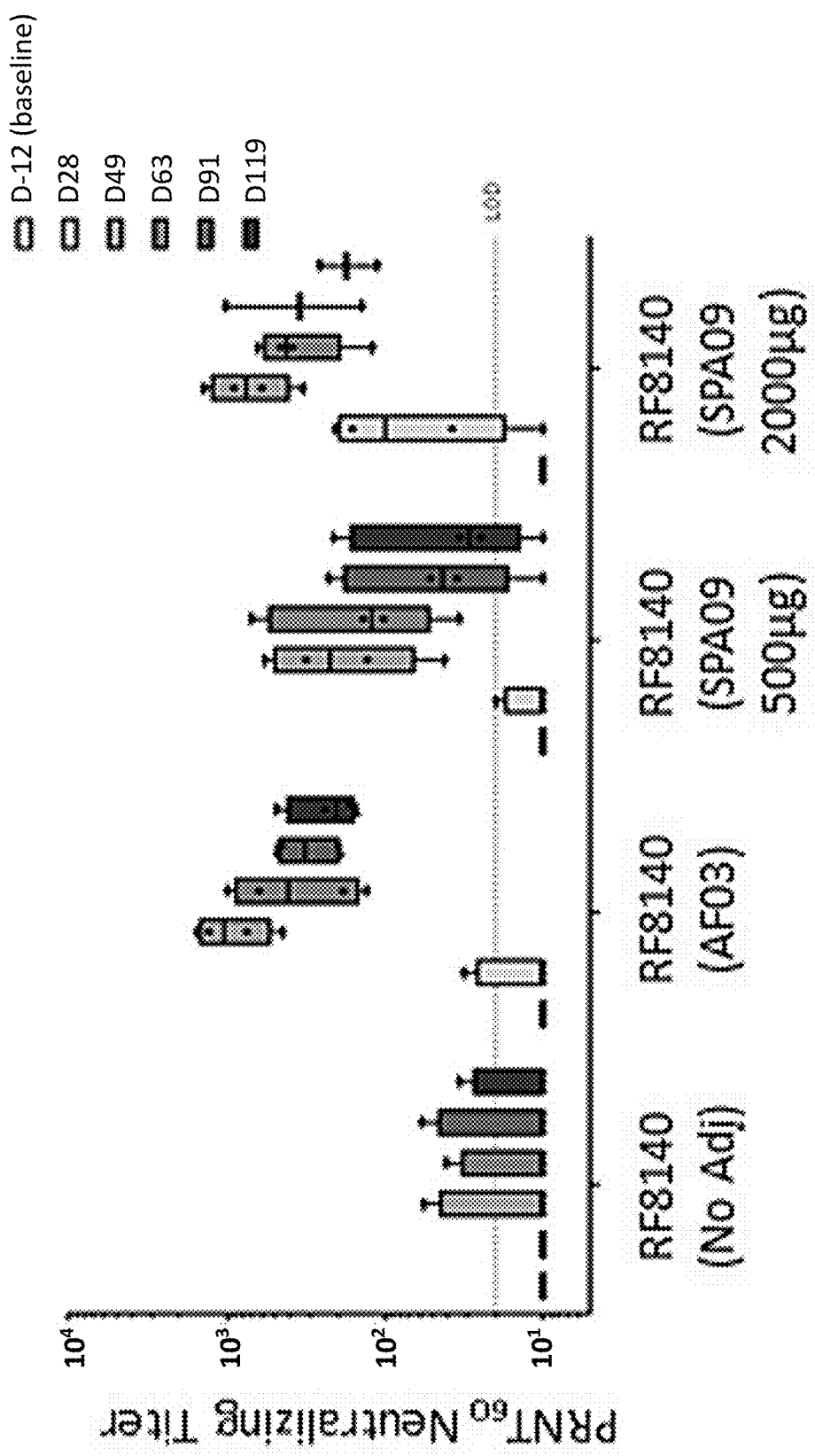

To further explore the adjuvanting effect of AF03 and SPA09, non-human primates (NHPs) were immunized with RF8140 unadjuvanted, adjuvanted with AF03, or adjuvanted with two doses of SPA09 (FIG. 104A). NHPs were immunized with 50 μg of antigen mixed with indicated adjuvant at days 0 and 29 and immune response was measured by ELISA or VERO neutralizing response at indicated time points. Pre-fusion F trimer ELISA responses were measured in NHP sera after immunization with RF8140 either unadjuvanted (No Adj), adjuvanted with AF03, or adjuvanted with SPA09 (500 μg and 2000 μg doses of SPA09 were used). At all timepoints, adjuvanting with AF03 or SPA09 elicits a superior neutralizing response. Neutralizing titers of sera for the above NHP groups were also measured by VERO cell assay (FIG. 104B). In all cases immunization with RF8140 with adjuvant elicits a higher neutralizing titer than non-adjuvanted groups at all timepoints.

The effect of direct conjugation of RF8140 (SEQ ID NO: 523) to TLR7/8 agonist SM7/8 or TLR9 agonist CpG was tested. The antigen was conjugated with the small molecules SM7/8 or CpG and mice were dosed with 10 μg. RF8140 contains a mutation in its ferritin sequence replacing a surface exposed amino acid with a cysteine (K79C), which can be used for conjugation by click chemistry. For comparison, mice were dosed with RF8140 either unadjuvanted (No-adj), or adjuvanted by mixing with the small molecule at a high or low dose (not conjugated) as indicated in FIG. 105. Sera from animals post-second and post-third immunization was tested for Pre-fusion F trimer-binding.

Figures 105A, 105B:
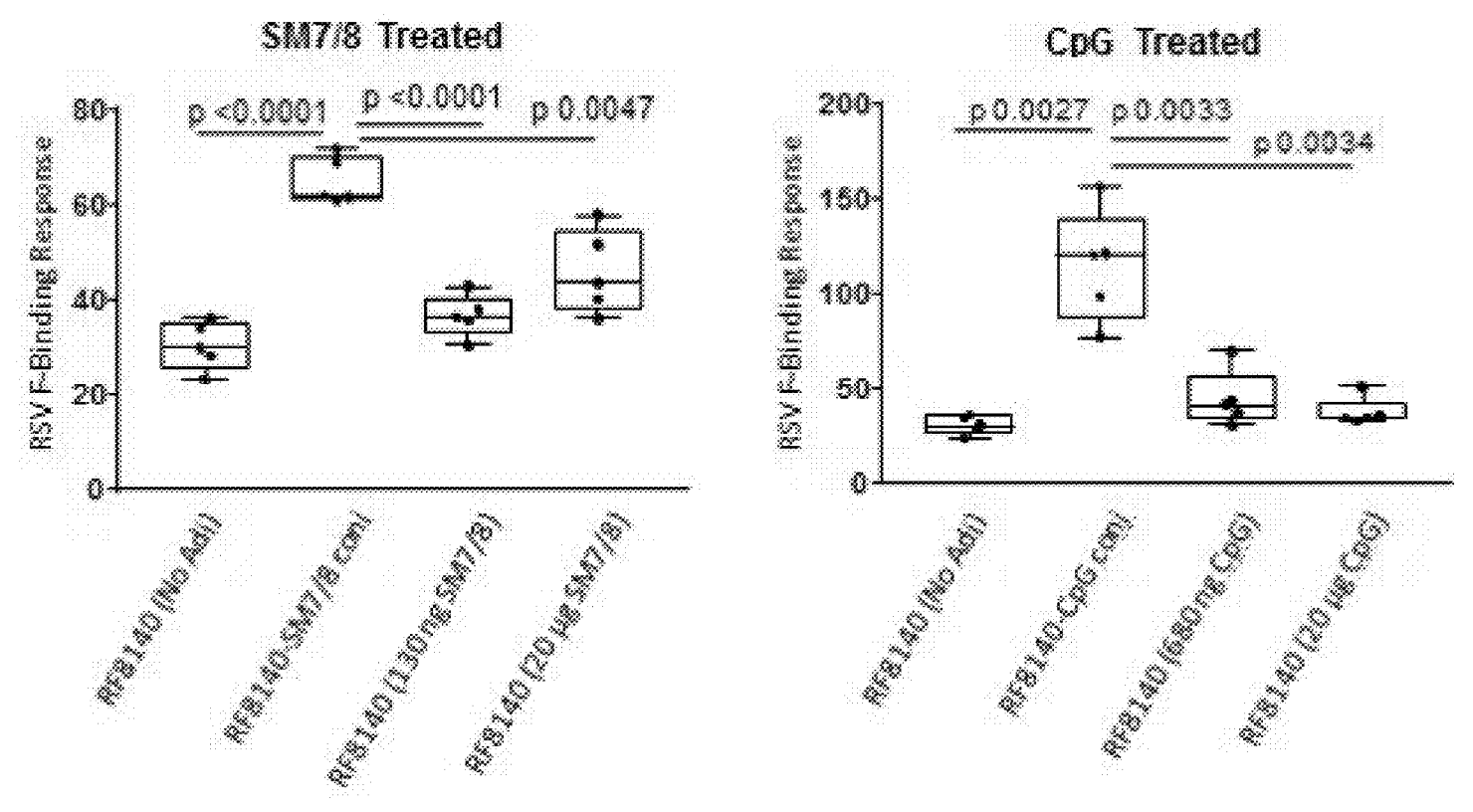

In FIG. 105A, pre-fusion F trimer-binding response was measured in sera from either naïve mice, mice immunized with unadjuvanted RF8140 (SEQ ID NO: 523), mice immunized with RF8140 (SEQ ID NO: 523) conjugated with SM7/8 adjuvant, RF8140 (SEQ ID NO: 523) adjuvanted with 130 ng of SM7/8, or RF8140 (SEQ ID NO: 523) adjuvanted with 20 μg SM7/8. RF8140 (SEQ ID NO: 523) conjugated to SM7/8 elicits a higher pre-fusion F trimer-binding titer than unadjuvanted or SM7/8 adjuvanted groups.

In FIG. 105B, pre-fusion F trimer-binding response was also measured in sera from either naïve mice, mice immunized with unadjuvanted RF8140 (SEQ ID NO: 523), mice immunized with RF8140 (SEQ ID NO: 523) conjugated with CpG adjuvant, RF8140 (SEQ ID NO: 523) adjuvanted with 680 ng of CpG, or RF8140 (SEQ ID NO: 523) adjuvanted with 20 μg CpG. RF8140 (SEQ ID NO: 523) conjugated to SM7/8 elicits a higher pre-fusion F trimer-binding titer than unadjuvanted or SM7/8 adjuvanted groups.

Figure 106D:
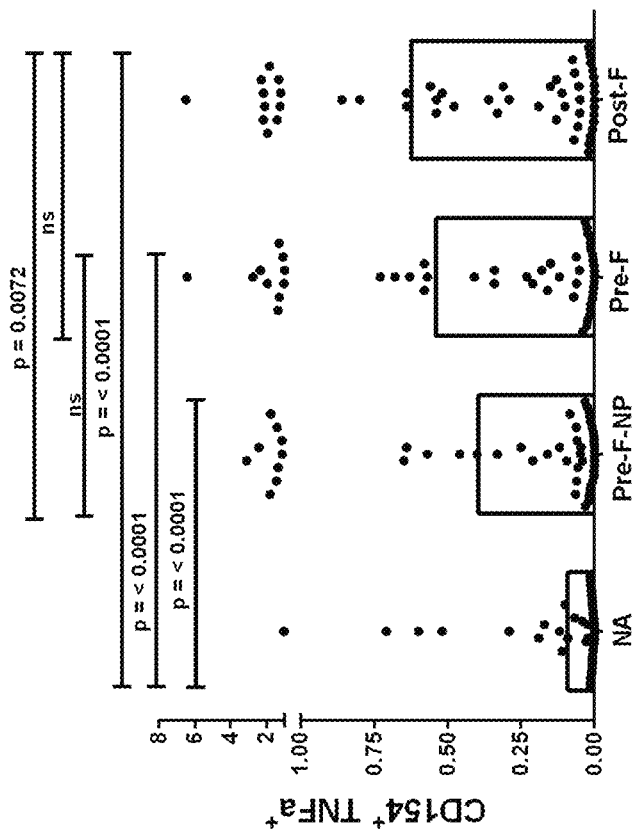
Figure 106C:
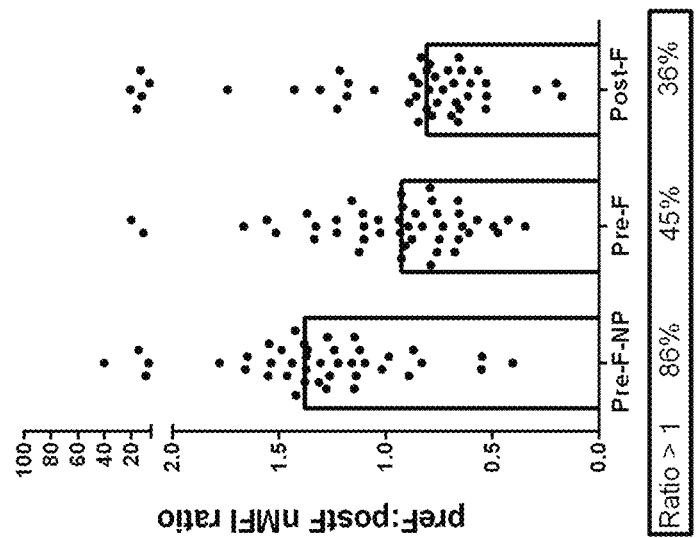

To demonstrate the ability of the Pre-F-NP antigen and the Gcc-NP antigen to elicit a response in human cells, experiments were performed with the MIMIC platform (FIGS. 106A-D). The MIMIC platform is comprised solely of autologous human immune cells capable of quickly and reproducibly generating antigen-specific innate and adaptive responses upon challenge. Previous work has demonstrated the ability of the MIMIC system to recapitulate in vivo immune profiles against such diverse targets as HBV, tetanus toxoid, monoclonal antibodies, YF-VAX, and influenza B-cell responses. RSV Pre-fusion F trimer-binding antibody responses elicited by treatment with Pre-F-NP RF8140 (SEQ ID NO: 523) versus post-fusion F trimer (SEQ ID NO: 524) were compared in human B-cells, and a representative baseline response is shown for comparison (No Treatment) (FIG. 106A). Ratios of measured binding responses to pre-fusion F trimer (DS-CAV1, SEQ ID NO: 525) versus post-fusion F trimer (SEQ ID NO: 524) elicited by treatment with Pre-F-NP (RF8140, SEQ ID NO: 523) versus Post-fusion F (SEQ ID NO: 524) in human B-cells are shown in FIG. 106C. Antibodies from MIMIC elicited by treatment with different F antigens were measured using the VERO cell assay (FIG. 106C). Neutralizing titers elicited by treatment with Pre-F NP (RF8140, SEQ ID NO: 523) versus Post-fusion F trimer (SEQ ID NO: 524) in human B-cells were compared to a no treatment group showing RF8140 (SEQ ID NO: 523) elicited a superior neutralizing response in human cells.

Figure 106F:
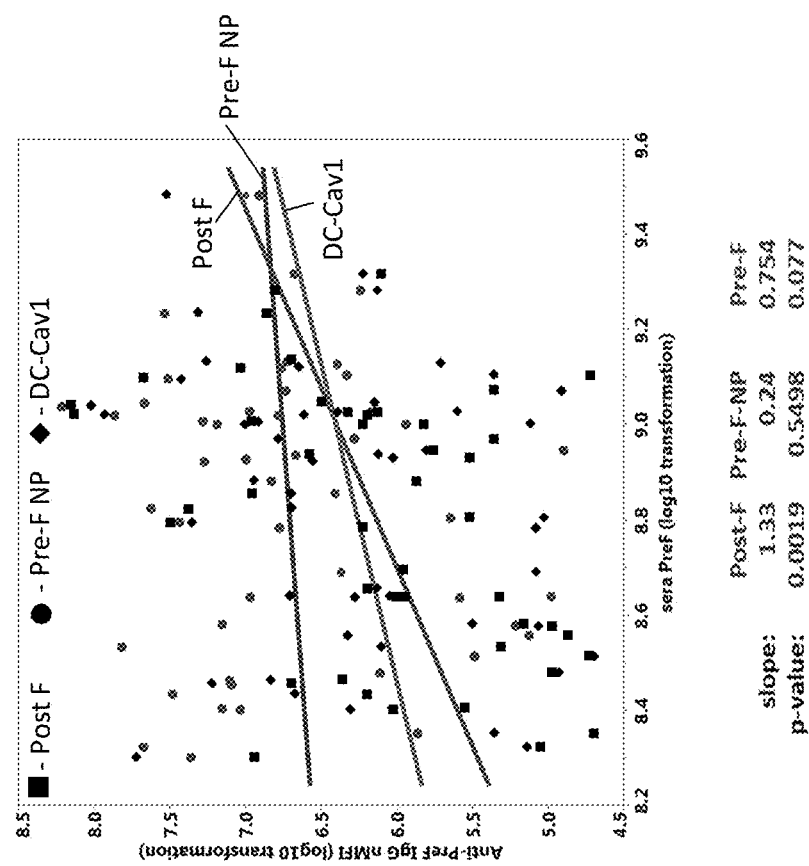
Figure 106E:
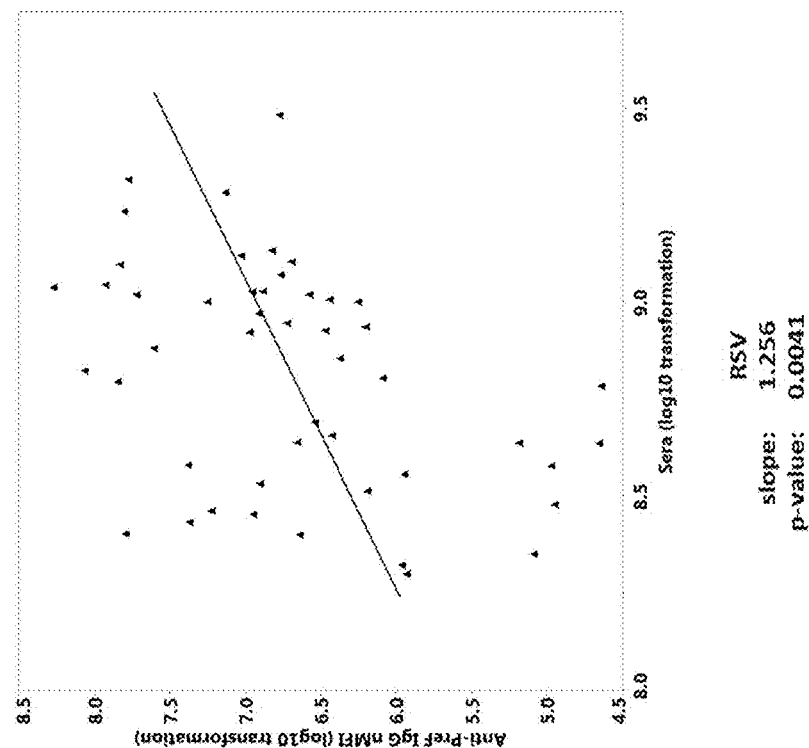

The magnitude of Ab response to RSV infection or to F subunit vaccine candidates was determined based on the sero-status of the human subjects investigated in MIMIC studies, which was assessed by linear regression analysis. Donors with higher pre-existing circulating titers of anti-pre-F IgG produced significantly more anti-pre-F IgG after RSV treatment (FIG. 106E, $p=0.0041$) and after post-F priming (FIG. 106F, $p=0.0019$). Although the correlation did not reach statistical significance, pre-F also showed a relationship between the level of Ab induced and the level of pre-existing Ab. It is noteworthy that unlike other treatments, pre-F-NP induced comparably high level of anti-pre-F IgG from donors with low pre-existing anti-pre-F IgG as from donors with high pre-existing Ab (FIG. 106F). This indicates that pre-F-NP is capable of rescuing (or enhancing) Ab response even from donors with low pre-existing IgG level effectively.

Figure 106G:
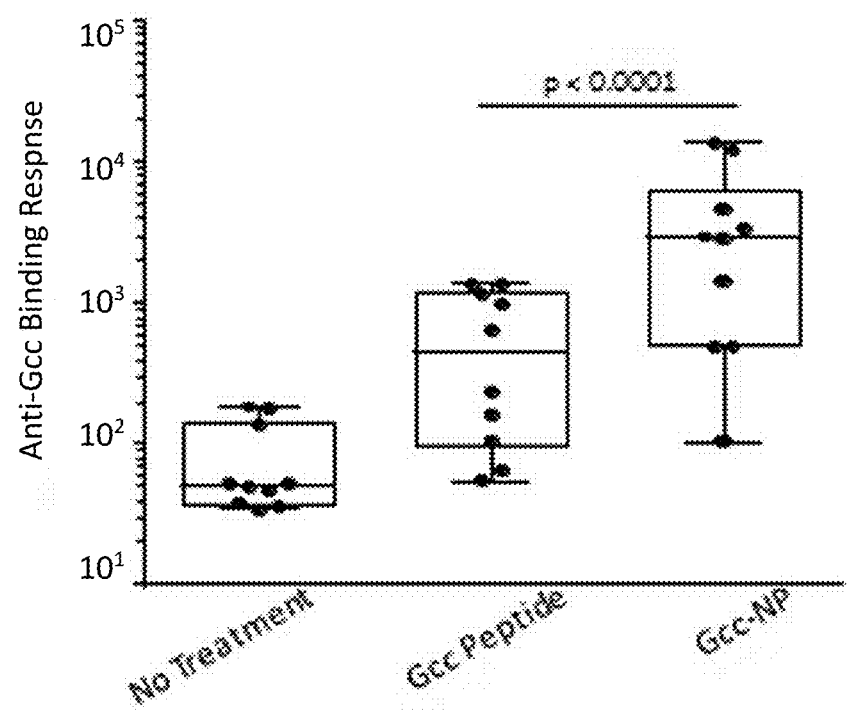

To demonstrate Gcc-NP elicits a superior G antibody response than Gcc peptide (SEQ ID NO: 529) alone, human cells were treated with Gcc peptide alone (SEQ ID NO: 529) or Gcc peptide conjugated to nanoparticle (Gcc-NP) in human B-cells. Gcc-NP elicited a superior G-binding antibody response (FIG. 106G). Combined, these data suggest the Pre-F-NP and Gcc-NP will elicit immune responses in human immunization.

Example 23: In Vivo Characterization of Immune Response to RSV Gcc-Ferritin Nanoparticles RSV Gcc-NP was prepared as described above. To assess the in vivo response to RSV Gcc-NP in mice, female BALBc mice were intramuscularly immunized with RSV antigens at specified doses at week 0, 3 and 6 with either a high dose (5 µg) or low dose (0.5 µg) of antigen. Unless otherwise noted, RSV Gcc-NP was adjuvanted with AF03 with a bedside mixing strategy. That is, 50 µl of the protein solution was mixed with 50 µl of Sanofi adjuvant AF03 (a squalene-based emulsion; see Klucker et al., J Pharm Sci. 2012 Dec; 101(12):4490-500) just prior to injection of 50 µl into each hind leg. No adverse effects from immunization were observed. Blood was collected 1 day prior to first immunization and at least 2 weeks after each injection (i.e. weeks 2, 5 and 8). Unless otherwise specified, data shown was for 2 weeks post third injection (week 8, also denoted as 2wp3). Typically, sera were analyzed from pre-immunized animals (denoted as naïve), two weeks post second injection (post-2 or 2wp2) or two weeks post third injection (post-$3^{rd}$ or 2wp3).

For the HAE neutralizing assay, serum was heat-inactivated for 30 minutes at 56° C. A fourfold serial dilution series of the inactivated serum was made in PneumaCult™-ALI Basal Medium (Stem Cell Technologies; 05002) supplemented with PneumaCult™-ALI 10× Supplement (Stem Cell Technologies; 05003) and 1% Antibiotic/Antimycotic (hence media). RSV viral stocks were combined 1:1 with the serum dilutions and incubated for 1.5 hours at 37° C. The virus-serum mixture was then added to 24 well plates containing fully differentiated HAE cells at 50 µL per well and incubated for 1 hour at 37° C., 5% CO2. Following incubation, the inoculum was removed, the wells were washed twice with media to remove unbound virus and incubated a further 20 hours at 37° C., 5% CO2. Infection events in cultures infected with RSV expressing the mKate (TagFP635) reporter were counted on a fluorescent microscope.

To detect infection with RSV not expressing the mKate reporter (RSV B strain neutralization), the pseudostratified epithelia were washed extensively with media to remove mucus then fixed with 4% paraformaldehyde for 30 minutes at room temperature, permeabilized with 0.25% Triton X-100 for 30 minutes, and blocked with DMEM supplemented with 2% FBS for 1 hour at 37° C. The blocking solution was replaced with 100 µL per well of Mouse Anti-RSV monoclonal Ab mixture (Millipore; MAB 858-4) diluted 1:200 in DMEM supplemented with 2% FBS, and the plates were incubated at 37° C. for 2 hours. The plates were then washed 3 times with PBS supplemented with 0.05% Tween 20. 100 µL of Goat anti-mouse IgG (H+L) (Invitrogen; A11001) diluted 1:200 in DMEM supplemented with 2% FBS was added per well, and the plates were incubated overnight at 4° C. Next morning, the plates were washed 3 times with PBS supplemented with 0.05% Tween 20, the florescent signal was stabilized with ProLong Gold AntiFade with DAPI (Thermo Fisher Scientific; P36935) and counted on a fluorescent microscope. The neutralizing antibody titers were determined at the 60% reduction endpoint.

Figure 107A:
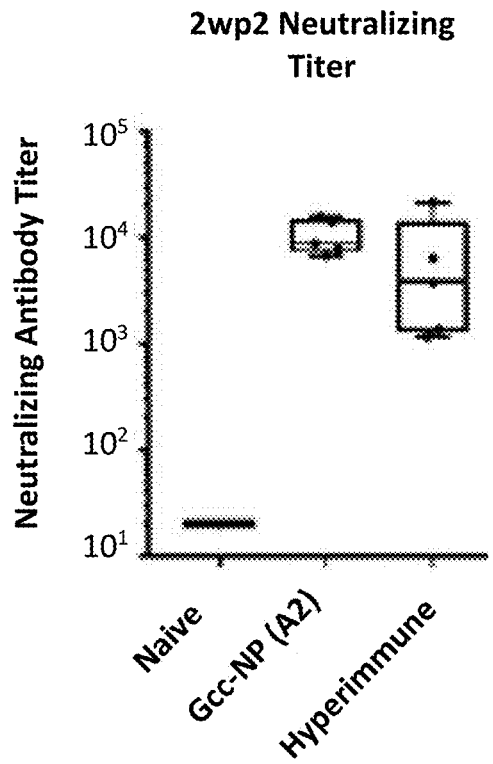
FIGS. 107A-C. Neutralizing antibody titers elicited by a low dose (0.5 µg) of RSV Gcc-ferritin nanoparticles ("Gcc-NP"). Shown are RSV A strain HAE neutralizing titers elicited from immunization with RSV Gcc-NP containing the RSV A2 Gcc sequence (formulated with AF03), from sera taken two weeks post the second immunization (2wp2) (FIG. 107A) or two weeks post the third immunization (2wp3) (FIG. 107B), with naïve and hyperimmune sera as negative and positive controls. Also shown is an RSV B strain HAE neutralizing titer elicited from immunization with RSV Gcc-NP containing the RSV A2 Gcc sequence (formulated with AF03), from sera taken two weeks post the third immunization (2wp3) (FIG. 107C).
Figure 107B:
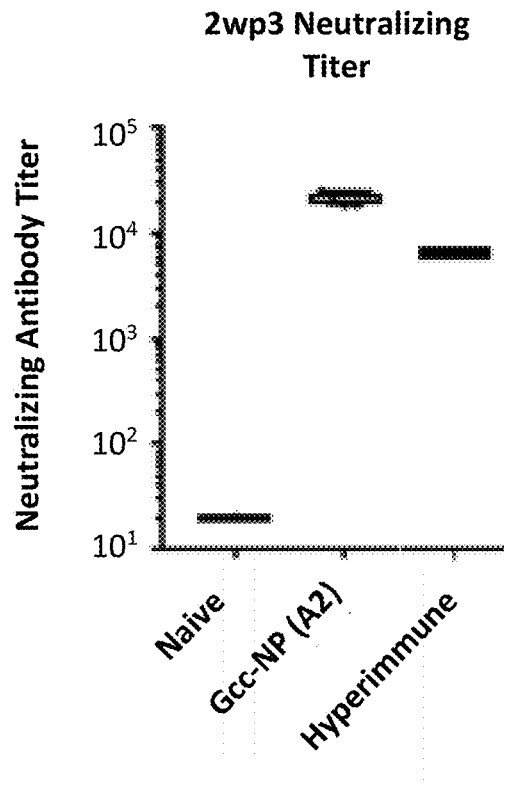
Figure 107C:
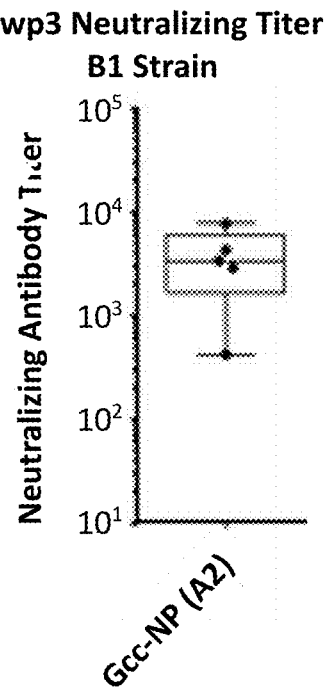

To demonstrate that higher multivalency improves elicitation of neutralizing response by RSV G antigens, mice were immunized with RSV F antigens. All immunizations were adjuvanted with AF03. Mice immunized with RSV Gcc-NP formulated with AF03 and neutralizing titers were measured at 2 weeks post second and 2 weeks post third injections (FIG. 107A-C). RSV Gcc-NP elicited a neutralizing response relative to naïve mouse sera. At both 2 weeks post second (FIG. 107A) and 2 weeks post third (FIG. 107B) immunization mice immunized with Gcc-NP, containing Gcc from the A2 strain showed neutralizing responses for RSV A strain. At 2 weeks post third injection, Gcc-NP also elicited a neutralizing response for the RSV B1 strain (FIG. 107C).

For anti-Gcc binding, a trimerized dimer of Gcc peptide with a C-terminal HIS tag was used on an Octet tip. A $His_6$-tagged Gcc (A2 strain) hexamer or $His_6$-tagged Gcc (B1 strain) hexamer was pre-loaded onto Anti-Penta-HIS (HIS1K) sensor tips (FortéBio #18-5122) for 400 seconds to allow capture to reach near saturation. Biosensor tips were then equilibrated for 90 seconds in Octet Wash Buffer, followed by diluted sera association for 300 seconds. Association curve final responses were measured using Octet Data Analysis HT10.0 software, and the response was multiplied by the dilution factor (100 or 300) to obtain the final reported response.

Figure 108A:
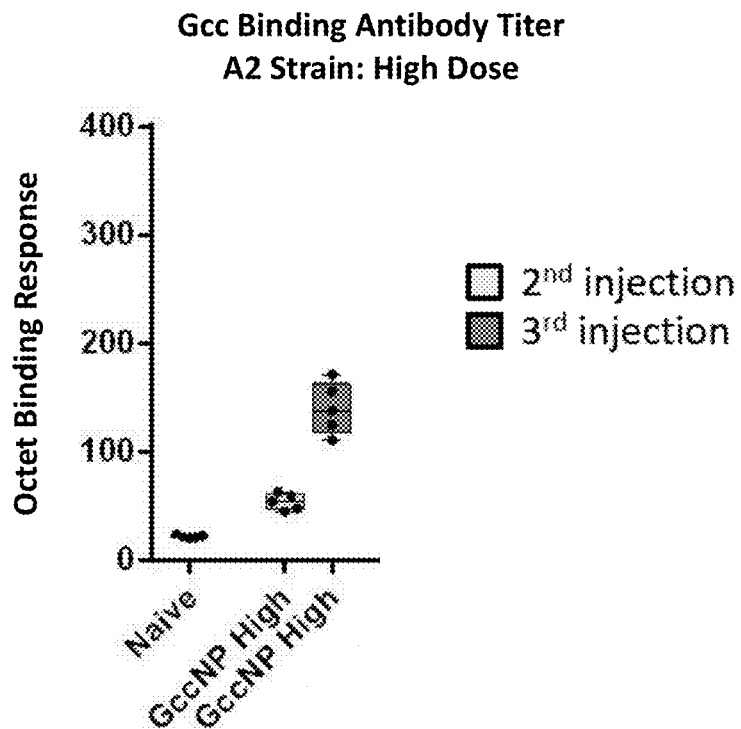
FIGS. 108A-B. RSV A2 strain antigen-binding antibody responses elicited by RSV Gcc-NP.
Figure 108B:
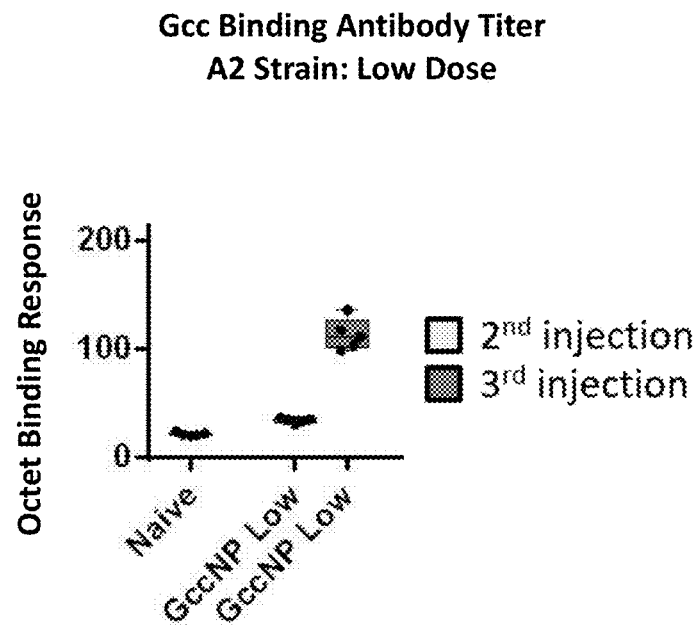
Figure 109A:
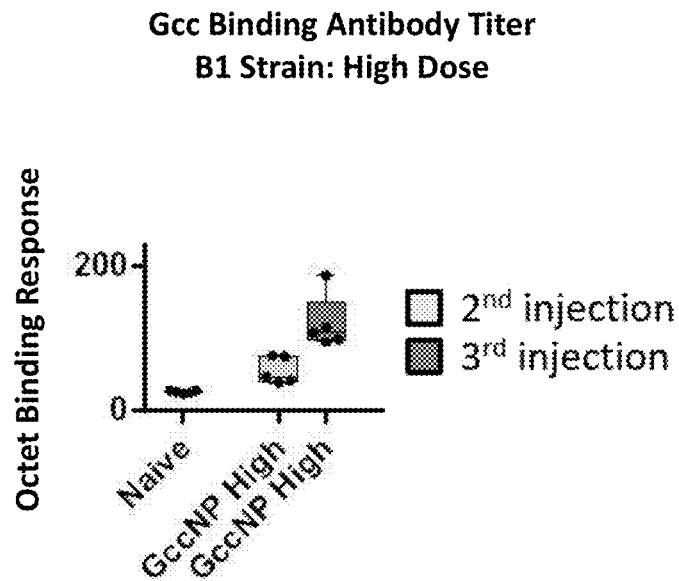
FIGS. 109A-B. RSV B1 strain antigen-binding antibody responses elicited by RSV Gcc-NP.
Figure 109B:
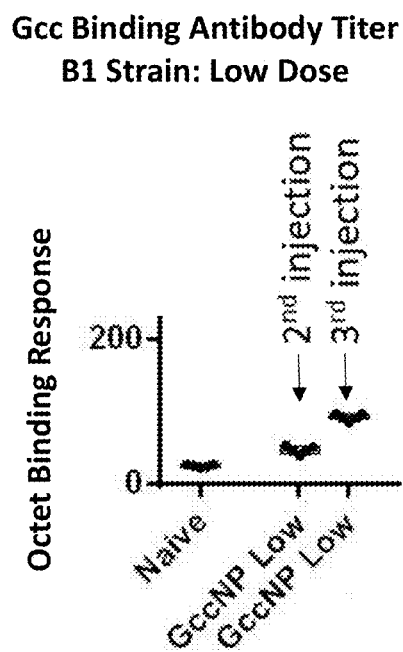

To determine if the RSV Gcc-NP elicits a Gcc-binding immune response, the sera from the immunizations described above were tested for their ability to bind Gcc A2 hexamer or Gcc B1 hexamer. The Gcc-binding response at high dose (FIG. 108A and FIG. 109A) and low dose (FIG. 108B and FIG. 109B) were tested at 2 weeks post-second and 2 weeks post-third immunizations. For both A2 strain (FIGS. 108A-B) and B1 strain (FIG. 109A-B), RSV Gcc-NP elicited a binding response relative to naïve mice sera.

Example 24: Response to Pre-F-NP and Gcc-NP in Human Cells

To demonstrate the ability of Pre-F-NP and Gcc-NP to elicit a response in human cells, experiments are performed with the MIMIC platform. The MIMIC platform is comprised solely of autologous human immune cells capable of quickly and reproducibly generating antigen-specific innate and adaptive responses upon challenge. Previous work has demonstrated the ability of the MIMIC system to recapitulate in vivo immune profiles against such diverse targets as HBV, tetanus toxoid, monoclonal antibodies, YF-VAX, and influenza B-cell responses. RSV Pre-fusion F trimer-binding antibody responses elicited by treatment with Pre-F-NP RF8140 (SEQ ID NO: 23) versus post-fusion F trimer (SEQ ID NO: 24) are compared in human B-cells, and are compared to a representative baseline response. Ratios of measured binding responses to pre-fusion F trimer (DS-CAV1, SEQ ID NO: 25) versus post-fusion F trimer (SEQ ID NO: 24) elicited by treatment with Pre-F-NP (RF8140, SEQ ID NO: 23) versus Post-fusion F (SEQ ID NO: 24) in human B-cells are determined. Antibodies from MIMIC elicited by treatment with different F antigens are measured using the VERO cell assay. Neutralizing titers elicited by treatment with Pre-F NP (RF8140, SEQ ID NO: 23) versus Post-fusion F trimer (SEQ ID NO: 24) in human B-cells are compared to a no treatment group, showing RF8140 (SEQ ID NO: 23) elicit a superior neutralizing response in human cells. To demonstrate Gcc-NP elicits a superior G antibody response than Gcc peptide (SEQ ID NO: 29) alone, human cells are treated with Gcc peptide alone (SEQ ID NO: 29) or Gcc peptide conjugated to nanoparticle (Gcc-NP) in human B-cells. Gcc-NP elicits a superior G-binding antibody response. Thus, Pre-F-NP and Gcc-NP will elicit immune responses in human immunization.

SEQUENCE LISTING (537 sequences)

SEQ ID NO: 1 - protein, 425 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 2 - protein, 425 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYDLKGELSSEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 3 - protein, 425 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFTLEGKVANEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 4 - protein, 425 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFALEGTLTDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 5 - protein, 425 aa, Artificial Sequence
  Synthetic polypeptide
MDEKNSASVDLPGEMKVLVSKEKDKDGKYSLKATVDKIELKGTSDKDNGSGVLEGTKDDKSKAKLTIADDLSKTTFELFKEDGKTLVSRKVSSKDKTSTDEMFNEKGELSAKTMTRENGTKLEYTEMKSDGTGKAKEVLKNFTLEGKVANDKVTLEVKEGTVTLSKEIAKSGEVTVALNDTNTTQATKKTGAWDSKTSTLTISVNSKKTTQLVFTKQDTITVQKYDSAGTNLEGTAVEIKTLDELKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 6 - protein, 426 aa, Artificial Sequence
  Synthetic polypeptide
MDEKNSVSVDLPGGMKVLVSKEKDKDGKYSLMATVEKLELKGTSDKSNGSGVLEGEKADKSKAKLTISQDLNQTTFEIFKEDGKTLVSRKVNSKDKSSTEEKFNDKGKLSEKVVTRANGTRLEYTEIKNDGSGKAKEVLKGFALEGTLTDGGETKLTVTEGTVTLSKNISKSGEITVALNDTETTPADKKTGEWKSDTSTLTISKNSQKPKQLVFTKENTITVQNYNRAGNALEGSPAEIKDLAELKAALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 7 - protein, 425 aa, Artificial Sequence
  Synthetic polypeptide
MDEKNSVSVDLPGEMKVLVSKEKDKDGKYSLMATVDKLELKGTSDKSNGSGTLEGEKSDKSKAKLTISEDLSKTTFEIFKEDGKTLVSKKVNSKDKSSIEEKFNAKGELSEKTILRANGTRLEYTEIKSDGTGKAKEVLKDFALEGTLAADKTTLKVTEGTVVLSKHIPNSGEITVELNDSNSTQATKKTGKWDSNTSTLTISVNSKKTKNIVFTKEDTITVQKYDSAGTNLEGNAVEIKTLDELKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 8 - protein, 426 aa, Artificial Sequence
  Synthetic polypeptide
MDEKNSVSVDLPGGMKVLVSKEKDKDGKYSLMATVEKLELKGTSDKNNGSGTLEGEKTDKSKVKLTIAEDLSKTTFEIFKEDGKTLVSKKVTLKDKSSTEEKFNEKGEISEKTIVRANGTRLEYTDIKSDGSGKAKEVLKDFTLEGTLAADGKTTLKVTEGTVVLSKNILKSGEITVALDDSDTTQATKKTGKWDSKTSTLTISVNSQKTKNLVFTKEDTITVQKYDSAGTNLEGKAVEITTLEKLKDALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 9 - protein, 426 aa, Artificial Sequence
  Synthetic polypeptide
MDEKNSVSVDLPGGMTVLVSKEKDKDGKYSLEATVDKLELKGTSDKNNGSGTLEGEKTDKSKVKSTIADDLSQTKFEIFKEDGKTLVSKKVTLKDKSSTEEKFNGKGETSEKTIVRANGTRLEYTDIKSDGSGKAKEVLKDFTLEGTLAADGKTTLKVTEGTVVLSKNILKSGEITAALDDSDTTRATKKTGKWDSKTSTLTISVNSQKTKNLVFTKEDTITVQRYDSAGTNLEGKAVEITTLKELKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 10 - protein, 426 aa, Artificial Sequence
  Synthetic polypeptide
MDEKNSVSVDLPGEMKVLVSKEKDKDGKYSLEATVDKLELKGTSDKNNGSGVLEGVKAAKSKAKLTIADDLSQTKFEIFKEDGKTLVSKKVTLKDKSSTEEKFNDKGKLSEKVVTRANGTRLEYTEIQNDGSGKAKEVLKSLTLEGTLTADGETKLTVEAGTVTLSKNISESGEITVELKDTETTPADKKSGTWDSKTSTLTISKNSQKTKQLVFTKENTITVQKYNTAGTKLEGSPAEIKDLEALKAALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 11 - protein, 265 aa, Artificial Sequence
  Synthetic polypeptide
MDEKNSVSVDLPGEMKVLVSKEKDKDGKYSLMATVDKLELKGTSDKSNGSGTLEGEKSDKSKAKLTISEDLSKTTFEIFKEDGKTLVSKKVNSKDKSSIEEKFNAKGELSEKTILRANGTRLEYTEIKSDGTGKAKEVLKDFALEGTLAADKTTLKVTEGTVVLSKHIPNSGEITVELNDSNSTQATKKTGKWDSNTSTLTISVNSKKTKNIVFTKEDTITVQKYDSAGTNLEGNAVEIKTLDELKNALKCLVPRGSLEHHHHHH

SEQ ID NO: 12 - protein, 408 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 13 - protein, 408 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYDLKGELSSEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 14 - protein, 408 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFTLEGKVANEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 15 - protein, 408 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFALEGTLTDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 16 - protein, 408 aa, Artificial Sequence
  Synthetic polypeptide
MDEKNSASVDLPGEMKVLVSKEKDKDGKYSLKATVDKIELKGTSDKDNGSGVLEGTKDDKSKAKLTIADDLSKTTFELFKEDGKTLVSRKVSSKDKTSTDEMFNEKGELSAKTMTRENGTKLEYTEMKSDGTGKAKEVLKNFTLEGKVANDKVTLEVKEGTVTLSKEIAKSGEVTVALNDTNTTQATKKTGAWDSKTSTLTISVNSKKTTQLVFTKQDTITVQKYDSAGTNLEGTAVEIKTLDELKNALKGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 17 - protein, 409 aa, Artificial Sequence
  Synthetic polypeptide
MDEKNSVSVDLPGGMKVLVSKEKDKDGKYSLMATVEKLELKGTSDKSNGSGVLEGEKADKSKAKLTISQDLNQTTFEIFKEDGKTLVSRKVNSKDKSSTEEKFNDKGKLSEKVVTRANGTRLEYTEIKNDGSGKAKEVLKGFALEGTLTDGGETKLTVTEGTVTLSKNISKSGEITVALNDTETTPADKKTGEWKSDTSTLTISKNSQKPKQLVFTKENTITVQNYNRAGNALEGSPAEIKDLAELKAALKGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 18 - protein, 408 aa, Artificial Sequence
  Synthetic polypeptide
MDEKNSVSVDLPGEMKVLVSKEKDKDGKYSLMATVDKLELKGTSDKSNGSGTLEGEKSDKSKAKLTISEDLSKTTFEIFKEDGKTLVSKKVNSKDKSSIEEKFNAKGELSEKTILRANGTRLEYTEIKSDGTGKAKEVLKDFALEGTLAADKTTLKVTEGTVVLSKHIPNSGEITVELNDSNSTQATKKTGKWDSNTSTLTISVNSKKTKNIVFTKEDTITVQKYDSAGTNLEGNAVEIKTLDELKNALKGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 19 - protein, 409 aa, Artificial Sequence
  Synthetic polypeptide
MDEKNSVSVDLPGGMKVLVSKEKDKDGKYSLMATVEKLELKGTSDKNNGSGTLEGEKTDKSKVKLTIAEDLSKTTFEIFKEDGKTLVSKKVTLKDKSSTEEKFNEKGEISEKTIVRANGTRLEYTDIKSDGSGKAKEVLKDFTLEGTLAADGKTTLKVTEGTVVLSKNILKSGEITVALDDSDTTQATKKTGKWDSKTSTLTISVNSQKTKNLVFTKEDTITVQKYDSAGTNLEGKAVEITTLEKLKDALKGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 20 - protein, 409 aa, Artificial Sequence
  Synthetic polypeptide
MDEKNSVSVDLPGGMTVLVSKEKDKDGKYSLEATVDKLELKGTSDKNNGSGTLEGEKTDKSKVKSTIADDLSQTKFEIFKEDGKTLVSKKVTLKDKSSTEEKFNGKGETSEKTIVRANGTRLEYTDIKSDGSGKAKEVLKDFTLEGTLAADGKTTLKVTEGTVVLSKNILKSGEITAALDDSDTTRATKKTGKWDSKTSTLTISVNSQKTKNLVFTKEDTITVQRYDSAGTNLEGKAVEITTLKELKNALKGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 21 - protein, 409 aa, Artificial Sequence
  Synthetic polypeptide
MDEKNSVSVDLPGEMKVLVSKEKDKDGKYSLEATVDKLELKGTSDKNNGSGVLEGVKAAKSKAKLTIADDLSQTKFEIFKEDGKTLVSKKVTLKDKSSTEEKFNDKGKLSEKVVTRANGTRLEYTEIQNDGSGKAKEVLKSLTLEGTLTADGETKLTVEAGTVTLSKNISESGEITVELKDTETTPADKKSGTWDSKTSTLTISKNSQKTKQLVFTKENTITVQKYNTAGTKLEGSPAEIKDLEALKAALKGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 22 - protein, 435 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSMTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 23 - protein, 435 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYDLKGELSSEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSMTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 24 - protein, 435 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFTLEGKVANEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSMTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 25 - protein, 435 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFALEGTLTDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSMTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 26 - protein, 435 aa, Artificial Sequence
  Synthetic polypeptide
MDEKNSASVDLPGEMKVLVSKEKDKDGKYSLKATVDKIELKGTSDKDNGSGVLEGTKDDKSKAKLTIADDLSKTTFELFKEDGKTLVSRKVSSKDKTSTDEMFNEKGELSAKTMTRENGTKLEYTEMKSDGTGKAKEVLKNFTLEGKVANDKVTLEVKEGTVTLSKEIAKSGEVTVALNDTNTTQATKKTGAWDSKTSTLTISVNSKKTTQLVFTKQDTITVQKYDSAGTNLEGTAVEIKTLDELKNALKGSMTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 27 - protein, 436 aa, Artificial Sequence
  Synthetic polypeptide
MDEKNSVSVDLPGGMKVLVSKEKDKDGKYSLMATVEKLELKGTSDKSNGSGVLEGEKADKSKAKLTISQDLNQTTFEIFKEDGKTLVSRKVNSKDKSSTEEKFNDKGKLSEKVVTRANGTRLEYTEIKNDGSGKAKEVLKGFALEGTLTDGGETKLTVTEGTVTLSKNISKSGEITVALNDTETTPADKKTGEWKSDTSTLTISKNSQKPKQLVFTKENTITVQNYNRAGNALEGSPAEIKDLAELKAALKGSMTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 28 - protein, 435 aa, Artificial Sequence
  Synthetic polypeptide
MDEKNSVSVDLPGEMKVLVSKEKDKDGKYSLMATVDKLELKGTSDKSNGSGTLEGEKSDKSKAKLTISEDLSKTTFEIFKEDGKTLVSKKVNSKDKSSIEEKFNAKGELSEKTILRANGTRLEYTEIKSDGTGKAKEVLKDFALEGTLAADKTTLKVTEGTVVLSKHIPNSGEITVELNDSNSTQATKKTGKWDSNTSTLTISVNSKKTKNIVFTKEDTITVQKYDSAGTNLEGNAVEIKTLDELKNALKGSMTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 29 - protein, 436 aa, Artificial Sequence
  Synthetic polypeptide
MDEKNSVSVDLPGGMKVLVSKEKDKDGKYSLMATVEKLELKGTSDKNNGSGTLEGEKTDKSKVKLTIAEDLSKTTFEIFKEDGKTLVSKKVTLKDKSSTEEKFNEKGEISEKTIVRANGTRLEYTDIKSDGSGKAKEVLKDFTLEGTLAADGKTTLKVTEGTVVLSKNILKSGEITVALDDSDTTQATKKTGKWDSKTSTLTISVNSQKTKNLVFTKEDTITVQKYDSAGTNLEGKAVEITTLEKLKDALKGSMTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 30 - protein, 436 aa, Artificial Sequence
  Synthetic polypeptide
MDEKNSVSVDLPGGMTVLVSKEKDKDGKYSLEATVDKLELKGTSDKNNGSGTLEGEKTDKSKVKSTIADDLSQTKFEIFKEDGKTLVSKKVTLKDKSSTEEKFNGKGETSEKTIVRANGTRLEYTDIKSDGSGKAKEVLKDFTLEGTLAADGKTTLKVTEGTVVLSKNILKSGEITAALDDSDTTRATKKTGKWDSKTSTLTISVNSQKTKNLVFTKEDTITVQRYDSAGTNLEGKAVEITTLKELKNALKGSMTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 31 - protein, 436 aa, Artificial Sequence
  Synthetic polypeptide
MDEKNSVSVDLPGEMKVLVSKEKDKDGKYSLEATVDKLELKGTSDKNNGSGVLEGVKAAKSKAKLTIADDLSQTKFEIFKEDGKTLVSKKVTLKDKSSTEEKFNDKGKLSEKVVTRANGTRLEYTEIQNDGSGKAKEVLKSLTLEGTLTADGETKLTVEAGTVTLSKNISESGEITVELKDTETTPADKKSGTWDSKTSTLTISKNSQKTKQLVFTKENTITVQKYNTAGTKLEGSPAEIKDLEALKAALKGSMTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 32 - protein, 426 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSMLSERMLKALNDQLNRELYSAYLYFAMAAYFEDLGLEGFANWMKAQAEEEIGHALRFYNYIYDRNGRVELDEIPKPPKEWESPLKAFEAAYEHEKFISKSIYELAALAEEEKDYSTRAFLEWFINEQVEEEASVKKILDKLKFAKDSPQILFMLDKELSARAPKLPGLLMQGGE

SEQ ID NO: 33 - protein, 426 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYDLKGELSSEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSMLSERMLKALNDQLNRELYSAYLYFAMAAYFEDLGLEGFANWMKAQAEEEIGHALRFYNYIYDRNGRVELDEIPKPPKEWESPLKAFEAAYEHEKFISKSIYELAALAEEEKDYSTRAFLEWFINEQVEEEASVKKILDKLKFAKDSPQILFMLDKELSARAPKLPGLLMQGGE

SEQ ID NO: 34 - protein, 426 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFTLEGKVANEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSMLSERMLKALNDQLNRELYSAYLYFAMAAYFEDLGLEGFANWMKAQAEEEIGHALRFYNYIYDRNGRVELDEIPKPPKEWESPLKAFEAAYEHEKFISKSIYELAALAEEEKDYSTRAFLEWFINEQVEEEASVKKILDKLKFAKDSPQILFMLDKELSARAPKLPGLLMQGGE

SEQ ID NO: 35 - protein, 426 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFALEGTLTDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSMLSERMLKALNDQLNRELYSAYLYFAMAAYFEDLGLEGFANWMKAQAEEEIGHALRFYNYIYDRNGRVELDEIPKPPKEWESPLKAFEAAYEHEKFISKSIYELAALAEEEKDYSTRAFLEWFINEQVEEEASVKKILDKLKFAKDSPQILFMLDKELSARAPKLPGLLMQGGE

SEQ ID NO: 36 - protein, 426 aa, Artificial Sequence
  Synthetic polypeptide
MDEKNSASVDLPGEMKVLVSKEKDKDGKYSLKATVDKIELKGTSDKDNGSGVLEGTKDDKSKAKLTIADDLSKTTFELFKEDGKTLVSRKVSSKDKTSTDEMFNEKGELSAKTMTRENGTKLEYTEMKSDGTGKAKEVLKNFTLEGKVANDKVTLEVKEGTVTLSKEIAKSGEVTVALNDTNTTQATKKTGAWDSKTSTLTISVNSKKTTQLVFTKQDTITVQKYDSAGTNLEGTAVEIKTLDELKNALKGSMLSERMLKALNDQLNRELYSAYLYFAMAAYFEDLGLEGFANWMKAQAEEEIGHALRFYNYIYDRNGRVELDEIPKPPKEWESPLKAFEAAYEHEKFISKSIYELAALAEEEKDYSTRAFLEWFINEQVEEEASVKKILDKLKFAKDSPQILFMLDKELSARAPKLPGLLMQGGE

SEQ ID NO: 37 - protein, 427 aa, Artificial Sequence
  Synthetic polypeptide
MDEKNSVSVDLPGGMKVLVSKEKDKDGKYSLMATVEKLELKGTSDKSNGSGVLEGEKADKSKAKLTISQDLNQTTFEIFKEDGKTLVSRKVNSKDKSSTEEKFNDKGKLSEKVVTRANGTRLEYTEIKNDGSGKAKEVLKGFALEGTLTDGGETKLTVTEGTVTLSKNISKSGEITVALNDTETTPADKKTGEWKSDTSTLTISKNSQKPKQLVFTKENTITVQNYNRAGNALEGSPAEIKDLAELKAALKGSMLSERMLKALNDQLNRELYSAYLYFAMAAYFEDLGLEGFANWMKAQAEEEIGHALRFYNYIYDRNGRVELDEIPKPPKEWESPLKAFEAAYEHEKFISKSIYELAALAEEEKDYSTRAFLEWFINEQVEEEASVKKILDKLKFAKDSPQILFMLDKELSARAPKLPGLLMQGGE

SEQ ID NO: 38 - protein, 426 aa, Artificial Sequence
  Synthetic polypeptide
MDEKNSVSVDLPGEMKVLVSKEKDKDGKYSLMATVDKLELKGTSDKSNGSGTLEGEKSDKSKAKLTISEDLSKTTFEIFKEDGKTLVSKKVNSKDKSSIEEKFNAKGELSEKTILRANGTRLEYTEIKSDGTGKAKEVLKDFALEGTLAADKTTLKVTEGTVVLSKHIPNSGEITVELNDSNSTQATKKTGKWDSNTSTLTISVNSKKTKNIVFTKEDTITVQKYDSAGTNLEGNAVEIKTLDELKNALKGSMLSERMLKALNDQLNRELYSAYLYFAMAAYFEDLGLEGFANWMKAQAEEEIGHALRFYNYIYDRNGRVELDEIPKPPKEWESPLKAFEAAYEHEKFISKSIYELAALAEEEKDYSTRAFLEWFINEQVEEEASVKKILDKLKFAKDSPQILFMLDKELSARAPKLPGLLMQGGE

SEQ ID NO: 39 - protein, 427 aa, Artificial Sequence
  Synthetic polypeptide
MDEKNSVSVDLPGGMKVLVSKEKDKDGKYSLMATVEKLELKGTSDKNNGSGTLEGEKTDKSKVKLTIAEDLSKTTFEIFKEDGKTLVSKKVTLKDKSSTEEKFNEKGEISEKTIVRANGTRLEYTDIKSDGSGKAKEVLKDFTLEGTLAADGKTTLKVTEGTVVLSKNILKSGEITVALDDSDTTQATKKTGKWDSKTSTLTISVNSQKTKNLVFTKEDTITVQKYDSAGTNLEGKAVEITTLEKLKDALKGSMLSERMLKALNDQLNRELYSAYLYFAMAAYFEDLGLEGFANWMKAQAEEEIGHALRFYNYIYDRNGRVELDEIPKPPKEWESPLKAFEAAYEHEKFISKSIYELAALAEEEKDYSTRAFLEWFINEQVEEEASVKKILDKLKFAKDSPQILFMLDKELSARAPKLPGLLMQGGE

SEQ ID NO: 40 - protein, 427 aa, Artificial Sequence
  Synthetic polypeptide
MDEKNSVSVDLPGGMTVLVSKEKDKDGKYSLEATVDKLELKGTSDKNNGSGTLEGEKTDKSKVKSTIADDLSQTKFEIFKEDGKTLVSKKVTLKDKSSTEEKFNGKGETSEKTIVRANGTRLEYTDIKSDGSGKAKEVLKDFTLEGTLAADGKTTLKVTEGTVVLSKNILKSGEITAALDDSDTTRATKKTGKWDSKTSTLTISVNSQKTKNLVFTKEDTITVQRYDSAGTNLEGKAVEITTLKELKNALKGSMLSERMLKALNDQLNRELYSAYLYFAMAAYFEDLGLEGFANWMKAQAEEEIGHALRFYNYIYDRNGRVELDEIPKPPKEWESPLKAFEAAYEHEKFISKSIYELAALAEEEKDYSTRAFLEWFINEQVEEEASVKKILDKLKFAKDSPQILFMLDKELSARAPKLPGLLMQGGE

SEQ ID NO: 41 - protein, 427 aa, Artificial Sequence
  Synthetic polypeptide
MDEKNSVSVDLPGEMKVLVSKEKDKDGKYSLEATVDKLELKGTSDKNNGSGVLEGVKAAKSKAKLTIADDLSQTKFEIFKEDGKTLVSKKVTLKDKSSTEEKFNDKGKLSEKVVTRANGTRLEYTEIQNDGSGKAKEVLKSLTLEGTLTADGETKLTVEAGTVTLSKNISESGEITVELKDTETTPADKKSGTWDSKTSTLTISKNSQKTKQLVFTKENTITVQKYNTAGTKLEGSPAEIKDLEALKAALKGSMLSERMLKALNDQLNRELYSAYLYFAMAAYFEDLGLEGFANWMKAQAEEEIGHALRFYNYIYDRNGRVELDEIPKPPKEWESPLKAFEAAYEHEKFISKSIYELAALAEEEKDYSTRAFLEWFINEQVEEEASVKKILDKLKFAKDSPQILFMLDKELSARAPKLPGLLMQGGE

SEQ ID NO: 42 - protein, 443 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSTQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 43 - protein, 443 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYDLKGELSSEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSTQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 44 - protein, 443 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFTLEGKVANEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSTQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 45 - protein, 443 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFALEGTLTDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSTQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 46 - protein, 443 aa, Artificial Sequence
  Synthetic polypeptide
MDEKNSASVDLPGEMKVLVSKEKDKDGKYSLKATVDKIELKGTSDKDNGSGVLEGTKDDKSKAKLTIADDLSKTTFELFKEDGKTLVSRKVSSKDKTSTDEMFNEKGELSAKTMTRENGTKLEYTEMKSDGTGKAKEVLKNFTLEGKVANDKVTLEVKEGTVTLSKEIAKSGEVTVALNDTNTTQATKKTGAWDSKTSTLTISVNSKKTTQLVFTKQDTITVQKYDSAGTNLEGTAVEIKTLDELKNALKGSTQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 47 - protein, 444 aa, Artificial Sequence
  Synthetic polypeptide
MDEKNSVSVDLPGGMKVLVSKEKDKDGKYSLMATVEKLELKGTSDKSNGSGVLEGEKADKSKAKLTISQDLNQTTFEIFKEDGKTLVSRKVNSKDKSSTEEKFNDKGKLSEKVVTRANGTRLEYTEIKNDGSGKAKEVLKGFALEGTLTDGGETKLTVTEGTVTLSKNISKSGEITVALNDTETTPADKKTGEWKSDTSTLTISKNSQKPKQLVFTKENTITVQNYNRAGNALEGSPAEIKDLAELKAALKGSTQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 48 - protein, 443 aa, Artificial Sequence
  Synthetic polypeptide
MDEKNSVSVDLPGEMKVLVSKEKDKDGKYSLMATVDKLELKGTSDKSNGSGTLEGEKSDKSKAKLTISEDLSKTTFEIFKEDGKTLVSKKVNSKDKSSIEEKFNAKGELSEKTILRANGTRLEYTEIKSDGTGKAKEVLKDFALEGTLAADKTTLKVTEGTVVLSKHIPNSGEITVELNDSNSTQATKKTGKWDSNTSTLTISVNSKKTKNIVFTKEDTITVQKYDSAGTNLEGNAVEIKTLDELKNALKGSTQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 49 - protein, 444 aa, Artificial Sequence
  Synthetic polypeptide
MDEKNSVSVDLPGGMKVLVSKEKDKDGKYSLMATVEKLELKGTSDKNNGSGTLEGEKTDKSKVKLTIAEDLSKTTFEIFKEDGKTLVSKKVTLKDKSSTEEKFNEKGEISEKTIVRANGTRLEYTDIKSDGSGKAKEVLKDFTLEGTLAADGKTTLKVTEGTVVLSKNILKSGEITVALDDSDTTQATKKTGKWDSKTSTLTISVNSQKTKNLVFTKEDTITVQKYDSAGTNLEGKAVEITTLEKLKDALKGSTQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 50 - protein, 444 aa, Artificial Sequence
  Synthetic polypeptide
MDEKNSVSVDLPGGMTVLVSKEKDKDGKYSLEATVDKLELKGTSDKNNGSGTLEGEKTDKSKVKSTIADDLSQTKFEIFKEDGKTLVSKKVTLKDKSSTEEKFNGKGETSEKTIVRANGTRLEYTDIKSDGSGKAKEVLKDFTLEGTLAADGKTTLKVTEGTVVLSKNILKSGEITAALDDSDTTRATKKTGKWDSKTSTLTISVNSQKTKNLVFTKEDTITVQRYDSAGTNLEGKAVEITTLKELKNALKGSTQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 51 - protein, 444 aa, Artificial Sequence
  Synthetic polypeptide
MDEKNSVSVDLPGEMKVLVSKEKDKDGKYSLEATVDKLELKGTSDKNNGSGVLEGVKAAKSKAKLTIADDLSQTKFEIFKEDGKTLVSKKVTLKDKSSTEEKFNDKGKLSEKVVTRANGTRLEYTEIQNDGSGKAKEVLKSLTLEGTLTADGETKLTVEAGTVTLSKNISESGEITVELKDTETTPADKKSGTWDSKTSTLTISKNSQKTKQLVFTKENTITVQKYNTAGTKLEGSPAEIKDLEALKAALKGSTQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 52 - protein, 455 aa, Artificial Sequence
  Synthetic polypeptide
MDSKGSSQKGSRLLLLLVVSNLLLPQGVLAMDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 53 - protein, 455 aa, Artificial Sequence
  Synthetic polypeptide
MDSKGSSQKGSRLLLLLVVSNLLLPQGVLAMDEKNSVSVDLPGEMKVLVSKEKNKDGKYDLIATVDKLELKGTSDKNQGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKQISKSGEVSVELQDTDSSAATKKTAAWNSGTSTLTITVNSKKTKDLVFTKENTITVQQYDSQGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 54 - protein, 455 aa, Artificial Sequence
  Synthetic polypeptide
MDSKGSSQKGSRLLLLLVVSNLLLPQGVLAMDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFTLEGKVANEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 55 - protein, 455 aa, Artificial Sequence
  Synthetic polypeptide
MDSKGSSQKGSRLLLLLVVSNLLLPQGVLAMDEKNSVSVDLPGEMKVLVSKEKNKDGKYDLIATVDKLELKGTSDKNQGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFTLEGKVANEKTTLVVKEGTVTLSKQISKSGEVSVELQDTDSSAATKKTAAWNSGTSTLTITVNSKKTKDLVFTKENTITVQQYDSQGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 56 - protein, 455 aa, Artificial Sequence
  Synthetic polypeptide
MDSKGSSQKGSRLLLLLVVSNLLLPQGVLAMDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFALEGTLTDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 57 - protein, 455 aa, Artificial Sequence
  Synthetic polypeptide
MDSKGSSQKGSRLLLLLVVSNLLLPQGVLAMDEKNSVSVDLPGEMKVLVSKEKNKDGKYDLIATVDKLELKGTSDKNQGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFALEGTLTDEKTTLVVKEGTVTLSKQISKSGEVSVELQDTDSSAATKKTAAWNSGTSTLTITVNSKKTKDLVFTKENTITVQQYDSQGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 58 - protein, 455 aa, Artificial Sequence
  Synthetic polypeptide
MDSKGSSQKGSRLLLLLVVSNLLLPQGVLAMDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYDLKGELSSEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 59 - protein, 455 aa, Artificial Sequence
  Synthetic polypeptide
MDSKGSSQKGSRLLLLLVVSNLLLPQGVLAMDEKNSVSVDLPGEMKVLVSKEKNKDGKYDLIATVDKLELKGTSDKNQGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYDLKGELSSEKTTLVVKEGTVTLSKQISKSGEVSVELQDTDSSAATKKTAAWNSGTSTLTITVNSKKTKDLVFTKENTITVQQYDSQGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 60 - protein, 457 aa, Artificial Sequence
  Synthetic polypeptide
MDSKGSSQKGSRLLLLLVVSNLLLPQGVLAMDEKNSVSVDLPGEMKVLVSKEKNKDGKYDLIATVDKLELKGTSDKNQGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKQISKSGEVSVELQDTDSSAATKKTAAWNSGTSTLTITVNSKKTKDLVFTKENTITVQQYDSQGTKLEGSAVEITKLDEIKNALKGGGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 61 - protein, 461 aa, Artificial Sequence
  Synthetic polypeptide
MDSKGSSQKGSRLLLLLVVSNLLLPQGVLAMDEKNSVSVDLPGEMKVLVSKEKNKDGKYDLIATVDKLELKGTSDKNQGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKQISKSGEVSVELQDTDSSAATKKTAAWNSGTSTLTITVNSKKTKDLVFTKENTITVQQYDSQGTKLEGSAVEITKLDEIKNALKGGGSGGGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 62 - protein, 473 aa, Artificial Sequence
  Synthetic polypeptide
MDSKGSSQKGSRLLLLLVVSNLLLPQGVLAMDEKNSVSVDLPGEMKVLVSKEKNKDGKYDLIATVDKLELKGTSDKNQGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKQISKSGEVSVELQDTDSSAATKKTAAWNSGTSTLTITVNSKKTKDLVFTKENTITVQQYDSQGTKLEGSAVEITKLDEIKNALKGGGSGGGSGGGSGGGSGGGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 63 - protein, 455 aa, Artificial Sequence
  Synthetic polypeptide
MDSKGSSQKGSRLLLLLVVSNLLLPQGVLAMDEKNSVSVDLPGEMKVLVSKEKNKDGKYDLIATVDKLELKGTSDKNNGAGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKNIAKSGEVSVELNDADSSAATKKTAAWNSGTSTLTITVNSKKTKDLVFTKENTITVQQYDSNGAKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 64 - protein, 455 aa, Artificial Sequence
  Synthetic polypeptide
MDSKGSSQKGSRLLLLLVVSNLLLPQGVLAMDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYVLEGTLTAEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 65 - protein, 455 aa, Artificial Sequence
  Synthetic polypeptide
MDSKGSSQKGSRLLLLLVVSNLLLPQGVLAMDEKNSASVDLPGEMKVLVSKEKDKDGKYSLKATVDKIELKGTSDKDNGSGVLEGTKDDKSKAKLTIADDLSKTTFELFKEDGKTLVSRKVSSKDKTSTDEMFNEKGELSAKTMTRENGTKLEYTEMKSDGTGKAKEVLKNFTLEGKVANDKVTLEVKEGTVTLSKEIAKSGEVTVALNDTNTTQATKKTGAWDSKTSTLTISVNSKKTTQLVFTKQDTITVQKYDSAGTNLEGTAVEIKTLDELKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 66 - protein, 455 aa, Artificial Sequence
  Synthetic polypeptide
MDSKGSSQKGSRLLLLLVVSNLLLPQGVLAMDEKNSASVDLPGEMKVLVSKEKDKDGKYSLKATVDKIELKGTSDKDQGSGVLEGTKDDKSKAKLTIADDLSKTTFELFKEDGKTLVSRKVSSKDKTSTDEMFNEKGELSAKTMTREQGTKLEYTEMKSDGTGKAKEVLKQFTLEGKVANDKVTLEVKEGTVTLSKEIAKSGEVTVALQDTQTTQATKKTGAWDSKTSTLTISVNSKKTTQLVFTKQDTITVQKYDSAGTNLEGTAVEIKTLDELKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 67 - protein, 456 aa, Artificial Sequence
  Synthetic polypeptide
MDSKGSSQKGSRLLLLLVVSNLLLPQGVLAMDEKNSVSVDLPGGMKVLVSKEKDKDGKYSLMATVEKLELKGTSDKSNGSGVLEGEKADKSKAKLTISQDLNQTTFEIFKEDGKTLVSRKVNSKDKSSTEEKFNDKGKLSEKVVTRANGTRLEYTEIKNDGSGKAKEVLKGFALEGTLTDGGETKLTVTEGTVTLSKNISKSGEITVALNDTETTPADKKTGEWKSDTSTLTISKNSQKPKQLVFTKENTITVQNYNRAGNALEGSPAEIKDLAELKAALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 68 - protein, 456 aa, Artificial Sequence
  Synthetic polypeptide
MDSKGSSQKGSRLLLLLVVSNLLLPQGVLAMDEKNSVSVDLPGGMKVLVSKEKDKDGKYSLMATVEKLELKGTSDKSQGSGVLEGEKADKSKAKLTISQDLQQTTFEIFKEDGKTLVSRKVNSKDKSSTEEKFNDKGKLSEKVVTRAQGTRLEYTEIKNDGSGKAKEVLKGFALEGTLTDGGETKLTVTEGTVTLSKQISKSGEITVALQDTETTPADKKTGEWKSDTSTLTISKNSQKPKQLVFTKENTITVQNYNRAGNALEGSPAEIKDLAELKAALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 69 - protein, 455 aa, Artificial Sequence
  Synthetic polypeptide
MDSKGSSQKGSRLLLLLVVSNLLLPQGVLAMDEKNSVSVDLPGEMKVLVSKEKDKDGKYSLMATVDKLELKGTSDKSNGSGTLEGEKSDKSKAKLTISEDLSKTTFEIFKEDGKTLVSKKVNSKDKSSIEEKFNAKGELSEKTILRANGTRLEYTEIKSDGTGKAKEVLKDFALEGTLAADKTTLKVTEGTVVLSKHIPNSGEITVELNDSNSTQATKKTGKWDSNTSTLTISVNSKKTKNIVFTKEDTITVQKYDSAGTNLEGNAVEIKTLDELKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 70 - protein, 455 aa, Artificial Sequence
  Synthetic polypeptide
MDSKGSSQKGSRLLLLLVVSNLLLPQGVLAMDEKNSVSVDLPGEMKVLVSKEKDKDGKYSLMATVDKLELKGTSDKSQGSGTLEGEKSDKSKAKLTISEDLSKTTFEIFKEDGKTLVSKKVNSKDKSSIEEKFNAKGELSEKTILRAQGTRLEYTEIKSDGTGKAKEVLKDFALEGTLAADKTTLKVTEGTVVLSKHIPNSGEITVELQDSQSTQATKKTGKWDSQTSTLTISVNSKKTKNIVFTKEDTITVQKYDSAGTNLEGNAVEIKTLDELKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 71 - protein, 456 aa, Artificial Sequence
  Synthetic polypeptide
MDSKGSSQKGSRLLLLLVVSNLLLPQGVLAMDEKNSVSVDLPGGMKVLVSKEKDKDGKYSLMATVEKLELKGTSDKNNGSGTLEGEKTDKSKVKLTIAEDLSKTTFEIFKEDGKTLVSKKVTLKDKSSTEEKFNEKGEISEKTIVRANGTRLEYTDIKSDGSGKAKEVLKDFTLEGTLAADGKTTLKVTEGTVVLSKNILKSGEITVALDDSDTTQATKKTGKWDSKTSTLTISVNSQKTKNLVFTKEDTITVQKYDSAGTNLEGKAVEITTLEKLKDALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 72 - protein, 456 aa, Artificial Sequence
  Synthetic polypeptide
MDSKGSSQKGSRLLLLLVVSNLLLPQGVLAMDEKNSVSVDLPGGMKVLVSKEKDKDGKYSLMATVEKLELKGTSDKNQGSGTLEGEKTDKSKVKLTIAEDLSKTTFEIFKEDGKTLVSKKVTLKDKSSTEEKFNEKGEISEKTIVRAQGTRLEYTDIKSDGSGKAKEVLKDFTLEGTLAADGKTTLKVTEGTVVLSKNILKSGEITVALDDSDTTQATKKTGKWDSKTSTLTISVNSQKTKNLVFTKEDTITVQKYDSAGTNLEGKAVEITTLEKLKDALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 73 - protein, 456 aa, Artificial Sequence
  Synthetic polypeptide
MDSKGSSQKGSRLLLLLVVSNLLLPQGVLAMDEKNSVSVDLPGGMTVLVSKEKDKDGKYSLEATVDKLELKGTSDKNQGSGTLEGEKTDKSKVKSTIADDLSQTKFEIFKEDGKTLVSKKVTLKDKSSTEEKFNGKGETSEKTIVRAQGTRLEYTDIKSDGSGKAKEVLKDFTLEGTLAADGKTTLKVTEGTVVLSKNILKSGEITAALDDSDTTRATKKTGKWDSKTSTLTISVNSQKTKNLVFTKEDTITVQRYDSAGTNLEGKAVEITTLKELKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 74 - protein, 456 aa, Artificial Sequence
  Synthetic polypeptide
MDSKGSSQKGSRLLLLLVVSNLLLPQGVLAMDEKNSVSVDLPGGMTVLVSKEKDKDGKYSLEATVDKLELKGTSDKNNGSGTLEGEKTDKSKVKSTIADDLSQTKFEIFKEDGKTLVSKKVTLKDKSSTEEKFNGKGETSEKTIVRANGTRLEYTDIKSDGSGKAKEVLKDFTLEGTLAADGKTTLKVTEGTVVLSKNILKSGEITAALDDSDTTRATKKTGKWDSKTSTLTISVNSQKTKNLVFTKEDTITVQRYDSAGTNLEGKAVEITTLKELKNALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 75 - protein, 456 aa, Artificial Sequence
  Synthetic polypeptide
MDSKGSSQKGSRLLLLLVVSNLLLPQGVLAMDEKNSVSVDLPGEMKVLVSKEKDKDGKYSLEATVDKLELKGTSDKNNGSGVLEGVKAAKSKAKLTIADDLSQTKFEIFKEDGKTLVSKKVTLKDKSSTEEKFNDKGKLSEKVVTRANGTRLEYTEIQNDGSGKAKEVLKSLTLEGTLTADGETKLTVEAGTVTLSKNISESGEITVELKDTETTPADKKSGTWDSKTSTLTISKNSQKTKQLVFTKENTITVQKYNTAGTKLEGSPAEIKDLEALKAALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 76 - protein, 456 aa, Artificial Sequence
  Synthetic polypeptide
MDSKGSSQKGSRLLLLLVVSNLLLPQGVLAMDEKNSVSVDLPGEMKVLVSKEKDKDGKYSLEATVDKLELKGTSDKNQGSGVLEGVKAAKSKAKLTIADDLSQTKFEIFKEDGKTLVSKKVTLKDKSSTEEKFNDKGKLSEKVVTRAQGTRLEYTEIQNDGSGKAKEVLKSLTLEGTLTADGETKLTVEAGTVTLSKQISESGEITVELKDTETTPADKKSGTWDSKTSTLTISKNSQKTKQLVFTKENTITVQKYNTAGTKLEGSPAEIKDLEALKAALKGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 77 - protein, 9 aa, Artificial Sequence
  Synthetic peptide
YVLEGTLTA

SEQ ID NO: 78 - protein, 9 aa, Artificial Sequence
  Synthetic peptide
YVIEGTSKQ

SEQ ID NO: 79 - protein, 9 aa, Artificial Sequence
  Synthetic peptide
FTLEGKVAN

SEQ ID NO: 80 - protein, 9 aa, Artificial Sequence
  Synthetic peptide
FALEGTLTD

SEQ ID NO: 81 - protein, 9 aa, Artificial Sequence
  Synthetic peptide
YTLEGQLSD

SEQ ID NO: 82 - protein, 9 aa, Artificial Sequence
  Synthetic peptide
YDLKGELSS

SEQ ID NO: 83 - protein, 273 aa, Borreliella burgdorferi
MKKYLLGIGLILALIACKQNVSSLDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYVLEGTLTAEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALK

SEQ ID NO: 84 - protein, 273 aa, Borreliella afzelii
MKKYLLGIGLILALIACKQNVSSLDEKNSASVDLPGEMKVLVSKEKDKDGKYSLKATVDKIELKGTSDKDNGSGVLEGTKDDKSKAKLTIADDLSKTTFELFKEDGKTLVSRKVSSKDKTSTDEMFNEKGELSAKTMTRENGTKLEYTEMKSDGTGKAKEVLKNFTLEGKVANDKVTLEVKEGTVTLSKEIAKSGEVTVALNDTNTTQATKKTGAWDSKTSTLTISVNSKKTTQLVFTKQDTITVQKYDSAGTNLEGTAVEIKTLDELKNALK

SEQ ID NO: 85 - protein, 274 aa, Borreliella garinii
MKKYLLGIGLILALIACKQNVSSLDEKNSVSVDLPGGMKVLVSKEKDKDGKYSLMATVEKLELKGTSDKSNGSGVLEGEKADKSKAKLTISQDLNQTTFEIFKEDGKTLVSRKVNSKDKSSTEEKFNDKGKLSEKVVTRANGTRLEYTEIKNDGSGKAKEVLKGFALEGTLTDGGETKLTVTEGTVTLSKNISKSGEITVALNDTETTPADKKTGEWKSDTSTLTISKNSQKPKQLVFTKENTITVQNYNRAGNALEGSPAEIKDLAELKAALK

SEQ ID NO: 86 - protein, 273 aa, Borreliella bavariensis
MKKYLLGIGLILALIACKQNVSSLDEKNSVSVDLPGEMKVLVSKEKDKDGKYSLMATVDKLELKGTSDKSNGSGTLEGEKSDKSKAKLTISEDLSKTTFEIFKEDGKTLVSKKVNSKDKSSIEEKFNAKGELSEKTILRANGTRLEYTEIKSDGTGKAKEVLKDFALEGTLAADKTTLKVTEGTVVLSKHIPNSGEITVELNDSNSTQATKKTGKWDSNTSTLTISVNSKKTKNIVFTKEDTITVQKYDSAGTNLEGNAVEIKTLDELKNALK

SEQ ID NO: 87 - protein, 274 aa, Borreliella garinii
MKKYLLGIGLILALIACKQNVSSLDEKNSVSVDLPGGMKVLVSKEKDKDGKYSLMATVEKLELKGTSDKNNGSGTLEGEKTDKSKVKLTIAEDLSKTTFEIFKEDGKTLVSKKVTLKDKSSTEEKFNEKGEISEKTIVRANGTRLEYTDIKSDGSGKAKEVLKDFTLEGTLAADGKTTLKVTEGTVVLSKNILKSGEITVALDDSDTTQATKKTGKWDSKTSTLTISVNSQKTKNLVFTKEDTITVQKYDSAGTNLEGKAVEITTLEKLKDALK

SEQ ID NO: 88 - protein, 274 aa, Borreliella burgdorferi
MKKYLLGIGLILALIACKQNVSSLDEKNSVSVDLPGGMTVLVSKEKDKDGKYSLEATVDKLELKGTSDKNNGSGTLEGEKTDKSKVKSTIADDLSQTKFEIFKEDGKTLVSKKVTLKDKSSTEEKFNGKGETSEKTIVRANGTRLEYTDIKSDGSGKAKEVLKDFTLEGTLAADGKTTLKVTEGTVVLSKNILKSGEITAALDDSDTTRATKKTGKWDSKTSTLTISVNSQKTKNLVFTKEDTITVQRYDSAGTNLEGKAVEITTLKELKNALK

SEQ ID NO: 89 - protein, 214 aa, Borreliella garinii
MKKYLLGIGLILALIACKQNVSSLDEKNSVSVDLPGEMKVLVSKEKDKDGKYSLEATVDKLELKGTSDKNNGSGVLEGVKAAKSKAKLTIADDLSQTKFEIFKEDGKTLVSKKVTLKDKSSTEEKFNDKGKLSEKVVTRANGTRLEYTEIQNDGSGKAKEVLKSLTLEGTLTADGETKLTENTITVQKYNTAGTKLEGSPAEIKDLEALKAALK

SEQ ID NO: 90 - protein, 173 aa, Artificial Sequence
  Synthetic polypeptide
ESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 91 - protein, 8 aa, Artificial Sequence
  Synthetic peptide
GGGSGGGS

SEQ ID NO: 92 - protein, 20 aa, Artificial Sequence
  Synthetic peptide
GGGSGGGSGGGSGGGSGGGS

SEQ ID NO: 93 - protein, 154 aa, Aquifex aeolicus
MQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 94 - protein, 250 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALK

SEQ ID NO: 95 - protein, 250 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYDLKGELSSEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALK

SEQ ID NO: 96 - protein, 250 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFTLEGKVANEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALK

SEQ ID NO: 97 - protein, 250 aa, Artificial Sequence
  Synthetic polypeptide
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFALEGTLTDEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALK

SEQ ID NO: 98 - protein, 250 aa, Artificial Sequence
  Synthetic polypeptide
MDEKNSVSVDLPGEMKVLVSKEKNKDGKYDLIATVDKLELKGTSDKNQGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYTLEGQLSDEKTTLVVKEGTVTLSKQISKSGEVSVELQDTDSSAATKKTAAWNSGTSTLTITVNSKKTKDLVFTKENTITVQQYDSQGTKLEGSAVEITKLDEIKNALK

SEQ ID NO: 99 - protein, 250 aa, Artificial Sequence
  Synthetic polypeptide
MDEKNSVSVDLPGEMKVLVSKEKNKDGKYDLIATVDKLELKGTSDKNQGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFTLEGKVANEKTTLVVKEGTVTLSKQISKSGEVSVELQDTDSSAATKKTAAWNSGTSTLTITVNSKKTKDLVFTKENTITVQQYDSQGTKLEGSAVEITKLDEIKNALK

SEQ ID NO: 100 - protein, 250 aa, Artificial Sequence
  Synthetic polypeptide
MDEKNSVSVDLPGEMKVLVSKEKNKDGKYDLIATVDKLELKGTSDKNQGSGVLEGVKADKSKVKLTISDDLGQTTLEVFKEDGKTLVSKKVTSKDKSSTEEKFNEKGEVSEKIITRADGTRLEYTGIKSDGSGKAKEVLKGFALEGTLTDEKTTLVVKEGTVTLSKQISKSGEVSVELQDTDSSAATKKTAAWNSGTSTLTITVNSKKTKDLVFTKENTITVQQYDSQGTKLEGSAVEITKLDEIKNALK

SEQ ID NO: 101 - protein, 250 aa, Artificial Sequence
  Synthetic polypeptide
MDEKNSVSVDLPGEMKVLVSKEKNKDGKYDLIATVDKLELKGTSDKNQGSGVLEGVKADKSKVKLTISDDLGQTTLEVFKEDGKTLVSKKVTSKDKSSTEEKFNEKGEVSEKIITRADGTRLEYTGIKSDGSGKAKEVLKGYDLKGELSSEKTTLVVKEGTVTLSKQISKSGEVSVELQDTDSSAATKKTAAWNSGTSTLTITVNSKKTKDLVFTKENTITVQQYDSQGTKLEGSAVEITKLDEIKNALK

SEQ ID NO: 102 - protein, 250 aa, Artificial Sequence
  Synthetic polypeptide
  SITE (1)..(250): /note="Variant residues given in the sequence have no preference with respect to those in the annotations for variant positions"
  VARIANT (48)..(48): /replace="Gln"
  MOD_RES (142)..(150): Any amino acid
  VARIANT (167)..(167): /replace="Gln"
  VARIANT (179)..(179): /replace="Gln"
  VARIANT (228)..(228): /replace="Gln"
MDEKNSVSVDLPGEMKVLVSKEKNKDGKYDLIATVDKLELKGTSDKNNGSGVLEGVKADKSKVKLTISDDLGQTTLEVFKEDGKTLVSKKVTSKDKSSTEEKFNEKGEVSEKIITRADGTRLEYTGIKSDGSGKAKEVLKGXXXXXXXXXEKTTLVVKEGTVTLSKNISKSGEVSVELNDTDSSAATKKTAAWNSGTSTLTITVNSKKTKDLVFTKENTITVQQYDSNGTKLEGSAVEITKLDEIKNALK

SEQ ID NO: 103-200 - skipped (98 entries)

SEQ ID NO: 201 - protein, 173 aa, Artificial Sequence
  Synthetic polypeptide
ESQVRQQFSKDIEKLLNEQVNKEMQSSNLYMCMSSWSYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 202 - protein, 173 aa, Artificial Sequence
  Synthetic polypeptide
ESQVRQQFSKDIEKLLNEQVNKEMQSSNLYMSMSSWSYTHSLDGAGLFLFDHAAEEYEHAKKLIIFLNENNVPVQLTCISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 203 - protein, 173 aa, Artificial Sequence
  Synthetic polypeptide
ESQVRQQFSKDIEKLLNEQVNKEMQSSNLYMSMSSWSYTHSLDGAGLFLFDHAAEEYEHAKKLIIFLNENNVPVQLTSISCPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 204 - protein, 173 aa, Artificial Sequence
  Synthetic polypeptide
ESQVRQQFSKDIEKLLNEQVNKEMQSSNLYMSMSSWSYTHSLDGAGLFLFDHAAEEYEHAKKLIIFLNENNVPVQLTSISAPEHCFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 205 - protein, 173 aa, Artificial Sequence
  Synthetic polypeptide
ESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISECINNIVDHAIKSKDHATFNFLQWYVAEQHEEEVLFKDILDKIELIGNENHGLYLADQYVKGIAKSRKS

SEQ ID NO: 206 - protein, 173 aa, Artificial Sequence; identical to SEQ ID NO: 90
  Synthetic polypeptide

SEQ ID NO: 207 - protein, 173 aa, Artificial Sequence
  Synthetic polypeptide
ESQVRQQFSKDIEKLLNCQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 208 - protein, 173 aa, Artificial Sequence
  Synthetic polypeptide
ESQVRQQFSKDIEKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 209 - protein, 166 aa, Helicobacter pylori
LSKDIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 210 - DNA, 22 bp, Artificial Sequence
  Synthetic oligonucleotide
tgactgtgaacgttcgagatga

SEQ ID NO: 211 - protein, 191 aa, Trichoplusia ni
TQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 212 - protein, 212 aa, Trichoplusia ni
ADTCYNDVALDCGITSNSLALPRCNAVYGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 213 - protein, 174 aa, Pyrococcus furiosus
MLSERMLKALNDQLNRELYSAYLYFAMAAYFEDLGLEGFANWMKAQAEEEIGHALRFYNYIYDRNGRVELDEIPKPPKEWESPLKAFEAAYEHEKFISKSIYELAALAEEEKDYSTRAFLEWFINEQVEEEASVKKILDKLKFAKDSPQILFMLDKELSARAPKLPGLLMQGGE

SEQ ID NO: 214 - protein, 183 aa, Homo sapiens
MTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVQQSLLELHKLATDKNDPHLCDFIETHYLNEQVKAIKELGDHVTNLRKMGAPESGLAEYLFDKHTLGDSDQES

SEQ ID NO: 215 - protein, 204 aa, Homo sapiens
MDSKGSSQKGSRLLLLLVVSNLLLPQGVLASSQIRQNYSTDVEAAVNSLVNLYLQASYTYLSLGFYFDRDDVALEGVSHFFRELAEEKREGYERLLKMQNQRGGRALFQDIKKPAEDEWGKTPDAMKAAMALEKKLNQALLDLHALGSARTDPHLCDFLETHFLDEEVKLIKKMGDHLTNLHRLGGPEAGLGEYLFERLTLKHD

SEQ ID NO: 216 - protein, 154 aa, Aquifex aeolicus; identical to SEQ ID NO: 93

SEQ ID NO: 217 - protein, 8 aa, Unknown
  Bullfrog linker sequence
ESQVRQQF

SEQ ID NO: 218 - protein, 15 aa, Artificial Sequence
  Synthetic peptide
CLVPRGSLEHHHHHH

SEQ ID NO: 219 - protein, 156 aa, Escherichia coli
MNIIEANVATPDARVAITIARFNNFINDSLLEGAIDALKRIGQVKDENITVVWVPGAYELPLAAGALAKTGKYDAVIALGTVIRGGTAHFEYVAGGASNGLAHVAQDSEIPVAFGVLTTESIEQAIERAGTKAGNKGAEAALTALEMINVLKAIKA

SEQ ID NO: 220 - protein, 16 aa, Artificial Sequence
  Synthetic peptide
GGGGSGGGGSGGGGSG

SEQ ID NO: 221 - protein, 28 aa, Artificial Sequence
  Synthetic peptide
GGSGSGSNSSASSGASSGGASGGSGGSG

SEQ ID NO: 222 - protein, 46 aa, Artificial Sequence
  Synthetic polypeptide
GGSGSASSGASASGSSNGSGSGSGSNSSASSGASSGGASGGSGGSG

SEQ ID NO: 223 - protein, 26 aa, Artificial Sequence
  Synthetic peptide
GGSGSASAEAAAKEAAAKAGGSGGSG

SEQ ID NO: 224 - protein, 32 aa, Artificial Sequence
  Synthetic polypeptide
GGSGSASAEAAAKEAAAKEAAAKASGGSGGSG

SEQ ID NO: 225 - protein, 47 aa, Artificial Sequence
  Synthetic polypeptide
SGGGSGSASSGASASGSSCSGSGSGSSSASSGASSGGASGGGSGGSG

SEQ ID NO: 226 - protein, 1086 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRAHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGSASSGASASGSSGSGSGSGSSSASSGLAYFLPPRVRGGGRVAAAAITWVPKPNVEVWPVDPPPPVNFNKTAEQEYGDKEVKLPHWTPTLHTFQVPQNYTKANCTYCNTREYTFSYKGCCFYFTKKKHTWNGCFQACAELYPCTYFYGPTPDILPVVTRNLNAIESLWVGVYRVGEGNWTSLDGGTFKVYQIFGSHCTYVSKFSTVPVSHHECSFLKPCLCVSQRSNSGSHHHHHH

SEQ ID NO: 227 - protein, 1339 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRAHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGSASSGASASGSSGSGSGSGSSSASSGLAYFLPPRVRGGGRVAAAAITWVPKPNVEVWPVDPPPPVNFNKTAEQEYGDKEVKLPHWTPTLHTFQVPQNYTKANCTYCNTREYTFSYKGCCFYFTKKKHTWNGCFQACAELYPCTYFYGPTPDILPVVTRNLNAIESLWVGVYRVGEGNWTSLDGGTFKVYQIFGSHCTYVSKFSTVPVSHHECSFLKPCLCVSQRSNSGGSGSASSGASASGSSGSGSGSGSSSASSGASSGGASGGSGGSGGGSGSASSGASASGSSGSGSGSGSSSASSGASSGGASGGSGGSGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 228 - protein, 1295 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRAHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGSASSGASASGSSGSGSGSGSSSASSGLAYFLPPRVRGGGRVAAAAITWVPKPNVEVWPVDPPPPVNFNKTAEQEYGDKEVKLPHWTPTLHTFQVPQNYTKANCTYCNTREYTFSYKGCCFYFTKKKHTWNGCFQACAELYPCTYFYGPTPDILPVVTRNLNAIESLWVGVYRVGEGNWTSLDGGTFKVYQIFGSHCTYVSKFSTVPVSHHECSFLKPCLCVSQRSNSGGSGSASSGASASGSSGSGSGSGSSSASSGASSGGASGGSGGSGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 229 - protein, 1263 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRAHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGSASSGASASGSSGSGSGSGSSSASSGLAYFLPPRVRGGGRVAAAAITWVPKPNVEVWPVDPPPPVNFNKTAEQEYGDKEVKLPHWTPTLHTFQVPQNYTKANCTYCNTREYTFSYKGCCFYFTKKKHTWNGCFQACAELYPCTYFYGPTPDILPVVTRNLNAIESLWVGVYRVGEGNWTSLDGGTFKVYQIFGSHCTYVSKFSTVPVSHHECSFLKPCLCVSQRSNSEPEPEPEPEPGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 230 - protein, 1255 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRAHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGSASSGASASGSSGSGSGSGSSSASSGLAYFLPPRVRGGGRVAAAAITWVPKPNVEVWPVDPPPPVNFNKTAEQEYGDKEVKLPHWTPTLHTFQVPQNYTKANCTYCNTREYTFSYKGCCFYFTKKKHTWNGCFQACAELYPCTYFYGPTPDILPVVTRNLNAIESLWVGVYRVGEGNWTSLDGGTFKVYQIFGSHCTYVSKFSTVPVSHHECSFLKPCLCVSQRSNSGGSGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 231 - protein, 1329 aa, Artificial Sequence
  Synthetic polypeptide
MDSKGSSQKGSRLLLLLVVSNLLLPQGVLANWAYPCCHVTQLRAQHLLALENISDIYLVSNQTCDAFSLASLNSPKQGSNQLVISRCANGLNVVSFFISILKRSSSALTGHLRELLTTLETLYGSFSVEDLFGAQLNRYAWHRGGGGSGSASSGASASGSSGGSGSGSGSGSSASSGASSGGASGGSGGSGAASLSEVKLHLDIEGHASHYTIPWTELLAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGEYSLVIVTTFVHYANFHNYFVPNLKDMFSRAVTMTAASYARYVLQKLVLLEMKGGCREPELETETLTTMFEVSVAFFKVGHAVGETGNGCVDLRWLAKSFFELTVLKDIIGICYGATVKGMQSYGLERLAAILMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSIAPQEATLDQAAVSQAVDGFLGRLSLEREDRDAWHLPAYKCVDRLDKVLMIIPLINVTFIISSDREVRGSALYEASTTYLSSSLFLSPVILNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGSASSGASASGSSGSGSGSGSSSASSGAITWVPKPNVEVWPVDPPPPVNFNKTAEQEYGDKEVKLPHWTPTLHTFQVPQNYTKANCTYCNTREYTFSYKGCCFYFTKKKHTWQGCFQACAELYPCTYFYGPTPDILPVVTRSLQAIESLWVGVYRVGEGNWTSLDGGTFKVYQIFGSHCTYVSKFSTVPVSHHECSFLKPCLCVSQRSNSGGSGSASSGASASGSSGSGSGSGSSSASSGASSGGASGGSGGSGGGSGSASSGASASGSSGSGSGSGSSSASSGASSGGASGGSGGSGESQVRSQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINQIVDHAIKCKDHATFNFLQWYVAEQHEEEVLFKDILDKIELIGQENHGLYLADQYVKGIAKSRKS

SEQ ID NO: 232 - protein, 1066 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRAHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGEPEPEPEPEPEPEPEPEPEPEPEPEPEPEPEPEPEPEPEPEPEPEPESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 233 - protein, 46 aa, Artificial Sequence
  Synthetic polypeptide
GGSGSASSGASASGSSGGSGSGSGSGSSASSGASSGGASGGSGGSG

SEQ ID NO: 234 - protein, 32 aa, Artificial Sequence
  Synthetic polypeptide
SGGGSGSASSGASASGSSGSGSGSGSSSASSG

SEQ ID NO: 235 - protein, 88 aa, Artificial Sequence
  Synthetic polypeptide
GGSGSASSGASASGSSGSGSGSGSSSASSGASSGGASGGSGGSGGGSGSASSGASASGSSGSGSGSGSSSASSGASSGGASGGSGGSG

SEQ ID NO: 236 - protein, 44 aa, Artificial Sequence
  Synthetic polypeptide
GGSGSASSGASASGSSGSGSGSGSSSASSGASSGGASGGSGGSG

SEQ ID NO: 237 - protein, 12 aa, Artificial Sequence
  Synthetic polypeptide
EPEPEPEPEPGG

SEQ ID NO: 238 - protein, 48 aa, Artificial Sequence
  Synthetic polypeptide
SGEPEPEPEPEPEPEPEPEPEPEPEPEPEPEPEPEPEPEPEPEPEPEP

SEQ ID NO: 239 - protein, 201 aa, Artificial Sequence
  Synthetic polypeptide
LAYFLPPRVRGGGRVAAAAITWVPKPNVEVWPVDPPPPVNFNKTAEQEYGDKEVKLPHWTPTLHTFQVPQNYTKANCTYCNTREYTFSYKGCCFYFTKKKHTWNGCFQACAELYPCTYFYGPTPDILPVVTRNLNAIESLWVGVYRVGEGNWTSLDGGTFKVYQIFGSHCTYVSKFSTVPVSHHECSFLKPCLCVSQRSNS

SEQ ID NO: 240 - protein, 183 aa, Artificial Sequence
  Synthetic polypeptide
AITWVPKPNVEVWPVDPPPPVNFNKTAEQEYGDKEVKLPHWTPTLHTFQVPQNYTKANCTYCNTREYTFSYKGCCFYFTKKKHTWQGCFQACAELYPCTYFYGPTPDILPVVTRSLQAIESLWVGVYRVGEGNWTSLDGGTFKVYQIFGSHCTYVSKFSTVPVSHHECSFLKPCLCVSQRSNS

SEQ ID NO: 241 - protein, 1329 aa, Artificial Sequence
  Synthetic polypeptide
MDSKGSSQKGSRLLLLLVVSNLLLPQGVLANWAYPCCHVTQLRAQHLLALENISDIYLVSNQTCDAFSLASLNSPKQGSNQLVISRCANGLNVVSFFISILKRSSSALTGHLRELLTTLETLYGSFSVEDLFGAQLNRYAWHRGGGGSGSASSGASASGSSGGSGSGSGSGSSASSGASSGGASGGSGGSGAASLSEVKLHLDIEGHASHYTIPWTELLAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGEYSLVIVTTFVHYANFHNYFVPNLKDMFSRAVTMTAASYARYVLQKLVLLEMKGGCREPELETETLTTMFEVSVAFFKVGHAVGETGNGCVDLRWLAKSFFELTVLKDIIGICYGATVKGMQSYGLERLAAILMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSIAPQEATLDQAAVSQAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGSASSGASASGSSGSGSGSGSSSASSGAITWVPKPNVEVWPVDPPPPVNFNKTAEQEYGDKEVKLPHWTPTLHTFQVPQNYTKANCTYCNTREYTFSYKGCCFYFTKKKHTWQGCFQACAELYPCTYFYGPTPDILPVVTRNLNAIESLWVGVYRVGEGNWTSLDGGTFKVYQIFGSHCTYVSKFSTVPVSHHECSFLKPCLCVSQRSNSGGSGSASSGASASGSSGSGSGSGSSSASSGASSGGASGGSGGSGGGSGSASSGASASGSSGSGSGSGSSSASSGASSGGASGGSGGSGESQVRSQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINQIVDHAIKCKDHATFNFLQWYVAEQHEEEVLFKDILDKIELIGQENHGLYLADQYVKGIAKSRKS

SEQ ID NO: 242 - protein, 1329 aa, Artificial Sequence
  Synthetic polypeptide
MDSKGSSQKGSRLLLLLVVSNLLLPQGVLANWAYPCCHVTQLRAQHLLALENISDIYLVSNQTCDAFSLASLNSPKQGSNQLVISRCANGLNVVSFFISILKRSSSALTGHLRELLTTLETLYGSFSVEDLFGAQLNRYAWHRGGGGSGSASSGASASGSSGGSGSGSGSGSSASSGASSGGASGGSGGSGAASLSEVKLHLDIEGHASHYTIPWTELLAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGEYSLVIVTTFVHYANFHNYFVPNLKDMFSRAVTMTAASYARYVLQKLVLLEMKGGCREPELETETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGSASSGASASGSSGSGSGSGSSSASSGAITWVPKPNVEVWPVDPPPPVNFNKTAEQEYGDKEVKLPHWTPTLHTFQVPQNYTKANCTYCNTREYTFSYKGCCFYFTKKKHTWNGCFQACAELYPCTYFYGPTPDILPVVTRNLNAIESLWVGVYRVGEGNWTSLDGGTFKVYQIFGSHCTYVSKFSTVPVSHHECSFLKPCLCVSQRSNSGGSGSASSGASASGSSGSGSGSGSSSASSGASSGGASGGSGGSGGGSGSASSGASASGSSGSGSGSGSSSASSGASSGGASGGSGGSGESQVRSQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINQIVDHAIKCKDHATFNFLQWYVAEQHEEEVLFKDILDKIELIGQENHGLYLADQYVKGIAKSRKS

SEQ ID NO: 243-300 - skipped (58 entries)

SEQ ID NO: 301 - protein, 685 aa, Artificial Sequence
  Synthetic polypeptide
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKSGS

SEQ ID NO: 302 - protein, 692 aa, Artificial Sequence
  Synthetic polypeptide
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 303 - protein, 692 aa, Artificial Sequence
  Synthetic polypeptide
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 304 - protein, 692 aa, Artificial Sequence
  Synthetic polypeptide
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGSESQVRQQFSKDIEKLLNCQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 305 - protein, 692 aa, Artificial Sequence
  Synthetic polypeptide
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGSESQVRQQFSKDIEKLLNEQVNKEMQSSNLYMCMSSWSYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 306 - protein, 692 aa, Artificial Sequence
  Synthetic polypeptide
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGSESQVRQQFSKDIEKLLNEQVNKEMQSSNLYMSMSSWSYTHSLDGAGLFLFDHAAEEYEHAKKLIIFLNENNVPVQLTCISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 307 - protein, 692 aa, Artificial Sequence
  Synthetic polypeptide
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGSESQVRQQFSKDIEKLLNEQVNKEMQSSNLYMSMSSWSYTHSLDGAGLFLFDHAAEEYEHAKKLIIFLNENNVPVQLTSISCPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 308 - protein, 692 aa, Artificial Sequence
  Synthetic polypeptide
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISECINNIVDHAIKSKDHATFNFLQWYVAEQHEEEVLFKDILDKIELIGNENHGLYLADQYVKGIAKSRKS

SEQ ID NO: 309 - protein, 698 aa, Artificial Sequence
  Synthetic polypeptide
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDENLYFQGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 310 - protein, 698 aa, Artificial Sequence
  Synthetic polypeptide
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDENLYFQGSESQVRQQFSKDIEKLLNEQVNKEMQSSNLYMCMSSWSYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 311 - protein, 698 aa, Artificial Sequence
  Synthetic polypeptide
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDENLYFQGSESQVRQQFSKDIEKLLNEQVNKEMQSSNLYMSMSSWSYTHSLDGAGLFLFDHAAEEYEHAKKLIIFLNENNVPVQLTCISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 312 - protein, 698 aa, Artificial Sequence
  Synthetic polypeptide
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDENLYFQGSESQVRQQFSKDIEKLLNEQVNKEMQSSNLYMSMSSWSYTHSLDGAGLFLFDHAAEEYEHAKKLIIFLNENNVPVQLTSISCPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 313 - protein, 698 aa, Artificial Sequence
  Synthetic polypeptide
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDENLYFQGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISECINNIVDHAIKSKDHATFNFLQWYVAEQHEEEVLFKDILDKIELIGNENHGLYLADQYVKGIAKSRKS

SEQ ID NO: 314 - protein, 694 aa, Artificial Sequence
  Synthetic polypeptide
MEARLLVLLCAFAATNADTICIGYHANNSTDTVDTVLEKNVTVTHSVNLLEDSHNGKLCKLKGIAPLQLGKCNIAGWLLGNPECDLLLTASSWSYIVETSNSENGTCFPGDFIDYEELREQLSSVSSFEKFEIFPKTSSWPNHETTKGVTAACSYAGASSFYRNLLWLTKKGSSYPKLSKSYVNNKGKEVLVLWGVHHPPTGTDQQSLYQNADAYVSVGSSKYNRRFTPEIAARPKVRDQAGRMNYYWTLLEPGDTITFEATGNLIAPWYAFALNRGSGSGIITSDAPVHDCNTKCQTPHGAINSSLPFQNIHPVTIGECPKYVRSTKLRMATGLRNIPSIQSRGLFGAIAGFIEGGWTGMIDGWYGYHHQNEQGSGYAADQKSTQNAIDGITNKVNSVIEKMNTQFTAVGKEFNNLERRIENLNKKVDDGFLDIWTYNAELLVLLENERTLDFHDSNVRNLYEKVKSQLKNNAKEIGNGCFEFYHKCDDACMESVRNGTYDYPKYSEESKLNREEIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 315 - protein, 694 aa, Artificial Sequence
  Synthetic polypeptide
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCFPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 316 - protein, 694 aa, Artificial Sequence
  Synthetic polypeptide
MKARLLILLCALSATDADTICIGYHANNSTDTVDTVLEKNVTVTHSVNLLEDSHNGKLCRLKGIAPLQLGKCNIAGWILGNPECESLLSNRSWSYIAETPNSENGICFPGDFADYEELREQLSSVSSFERFEIFPKESSWPKHNITRGVTVACSHAKKSSFYKNLLWLTEANGLYPSLSKSYVNDREKEVLVLWGVHHPSNIEDQRTLYRKENAYVSVVSSNYNRRFTPEIAERPKVRGQPGRMNYYWTLLEPGDKIIFEANGNLIAPWYAFALSRGPGSGIITSNASMDECDTKCQTPQGAINSSLPFQNIHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCDNECMESVKNGTYDYPKYSEESKLNRAKIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 317 - protein, 694 aa, Artificial Sequence
  Synthetic polypeptide
MKAKLLILLCALTATDADTICIGYHANNSTDTVDTVLEKNVTVTHSVNLLEDSHNGKLCRLKGIAPLQLGKCNIAGWILGNPECESLLSKRSWSYIAETPNSENGACFPGDFADYEELREQLSSVSSFERFEIFPKERSWPKHNITRGVTAACSHAGKSSFYKNLLWLTETDGSYPKLSKSYVNNKEKEVLVLWGVHHPSNIEDQKTLYRKENAYVSVVSSNYNRRFTPEIAERPKVRGQAGRINYYWTLLEPGDTIIFEANGNLIAPWYAFALSRDFGSGIITSNASMDECDTKCQTPQGAINSSLPFQNIHPVTIGECPKYVKSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCNNECMESVKNGTYDYPKYSEESKLNREKIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 318 - protein, 694 aa, Artificial Sequence
  Synthetic polypeptide
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCFPGYFADYEELREQLSSVSSFERFEIFPKERSWPKHNVTRGVTASCSHKGKSSFYRNLLWLTEKNGSYPNLSKSYVNNKEKEVLVLWGVHHPSNIEDQKTIYRKENAYVSVVSSNYNRRFTPEIAERPKVRGQAGRINYYWTLLEPGDTIIFEANGNLIAPWYAFALSRGFGSGIITSNASMDECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 319 - protein, 690 aa, Artificial Sequence
  Synthetic polypeptide
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCFPGSFNDYEELKHLLSSVKHFEKVKILPKDRWTQHTTTGGSRACAVSGNPSFFRNMVWLTKKESNYPVAKGSYNNTSGEQMLIIWGVHHPNDETEQRTLYQNVGTYVSVGTSTLNKRSTPDIATRPKVNGLGSRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 320 - protein, 692 aa, Artificial Sequence
  Synthetic polypeptide
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCFPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 321 - protein, 693 aa, Artificial Sequence
  Synthetic polypeptide
MKAKLLILLCALSATDADTICIGYHANNSTDTVDTVLEKNVTVTHSVNLLEDSHNGKLCRLKGKAPLQLGNCNIAGWVLGNPECESLLSNRSWSYIAETPNSENGTCFPGDFADYEELREQLSSVSSFERFEIFPKERSWPNHTTRGVTAACPHARKSSFYKNLVWLTEANGSYPNLSRSYVNNQEKEVLVLWGVHHPSNIEEQRALYRKDNAYVSVVSSNYNRRFTPEIAKRPKVRDQSGRMNYYWTLLEPGDTIIFEATGNLIAPWYAFALSRGPGSGIITSNAPLDECDTKCQTPQGAINSSLPFQNIHPVTIGECPKYVRSTKLRMVTGLRNIPSVQSRGLFGAIAGFIEGGWTGMMDGWYGYHHQNEQGSGYAADQKSTQNAINGITNKVNSVIEKMNTQFTAVGKEFNKLEKRMENLNKKVDDGFMDIWTYNAELLVLLENERTLDFHDSNVKNLYEKVKNQLRNNAKELGNGCFEFYHKCDNECMESVKNGTYDYPKYSEESKLNREKIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 322 - protein, 694 aa, Artificial Sequence
  Synthetic polypeptide
MKTTIILILLTHWAYSQNPISGNNTATLCLGHHAVANGTLVKTISDDQIEVTNATELVQSISMGKICNNSYRILDGRNCTLIDAMLGDPHCDAFQYENWDLFIERSSAFSNCFPYDIPDYASLRSIVASSGTLEFTAEGFTWTGVTQNGRSGACKRGSADSFFSRLNWLTKSGSSYPTLNVTMPNNKNFDKLYIWGIHHPSSNQEQTKLYIQESGRVTVSTKRSQQTIIPNIGSRPWVRGQSGRISIYWTIVKPGDILMINSNGNLVAPRGYFKLKTGKSSVMRSDVPIDICVSECITPNGSISNDKPFQNVNKVTYGKCPKYIRQNTLKLATGMRNVPEKQIRGIFGAIAGFIENGWEGMVDGWYGFRYQNSEGTGQAADLKSTQAAIDQINGKLNRVIERTNEKFHQIEKEFSEVEGRIQDLEKYVEDTKIDLWSYNAELLVALENQHTIDLTDAEMNKLFEKTRRQLRENAEDMGGGCFKIYHKCDNACIGSIRNGTYDHYIYRDEALNNRFKIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 323 - protein, 696 aa, Artificial Sequence
  Synthetic polypeptide
MKTTIIFIFILLTHWAYSQNPISDNNTATLCLGHHAVANGTLVKTISDDQIEVTNATELVQSISMGKICNNSYRILDGRNCTLIDAMLGDPHCDVFQYENWDLFIERSSAFSNCFPYDIPDYASLRSIVASSGTLEFTAEGFTWTGVTQNGRSGACKRGSADSFFSRLNWLTKSGNSYPTLNVTMPNNKNFDKLYIWGIHHPSSNQEQTKLYIQESGRVTVSTKRSQQTMIPNIGSRPWVRGQSGRISIYWTIVKPGDILMINSNGNLVAPRGYFKLKTGKSSVMRSDVPIDICVSECITPNGSISNDKPFQNVNKVTYGKCPKYIRQNTLKLATGMRNVPEKQIRGIFGAIAGFIENGWEGMVDGWYGFRYQNSEGTGQAADLKSTQAAIDQINGKLNRVIERTNEKFHQIEKEFSEVEGRIQDLEKYVEDTKIDLWSYNAELLVALENQHTIDLTDAEMNKLFEKTRRQLRENAEDMGGGCFKIYHKCDNACIGSIRNGTYDHYIYRDEALNNRFKIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 324 - protein, 694 aa, Artificial Sequence
  Synthetic polypeptide
METTIILILLTHWVYSQNPISGNNTATLCLGHHAVANGTLVKTITDDQIEVTNATELVESISMGKICNNSYRVLDGRNCTLIDAMLGDPHCDDFQYESWDLFIERSSASSNCFPYDIPDYASLRSIVASSGTLEFTAEGFTWTGVTQNGRSGACKRGSADSFFSRLNWLTKSGNSYPTLNVTMPNNKNFDKLYIWGIHHPSSNKEQTKLYIQESGRVTVSTERSQQTVIPNIGSRPWVRGQSGRISIYWTIVKPGDVLMINSNGNLVAPRGYFKLRTGKSSVMRSDALIDTCVSECITPNGSIPNDKPFQNVNKITYGRCPKYIRQNTLKLATGMRNVPEKQIRGIFGAIAGFIENGWEGMVDGWYGFRYQNSEGTGQAADLKSTQAAIDQINGKLNRVIERTNEKFHQIEKEFSEVEGRIQDLEKYVEDTKIDLWSYNAELLVALENQHTIDLTDAEMNKLFERTRRQLRENAEDMGGGCFKIYHKCDNACIGSIRNGTYDHYIYRDEALNNRFKIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 325 - protein, 711 aa, Artificial Sequence
  Synthetic polypeptide
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITASGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 326 - protein, 713 aa, Artificial Sequence
  Synthetic polypeptide
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 327 - protein, 694 aa, Artificial Sequence
  Synthetic polypeptide
MKARLLVLLCALAATDADTICIGYHANNSTDTVDTVLEKNVTVTHSVNLLEDSHNGKLCKLKGIAPLQLGKCNIAGWLLGNPECESLLSARSWSYIVETPNSENGTCFPGDFIDYEELREQLSSVSSFERFEIFPKESSWPNHNTTKGVTAACSHAGKSSFYRNLLWLTKKGGSYPKLSKSYVNNKGKEVLVLWGVHHPSTSTDQQSLYQNENAYVSVVSSNYNRRFTPEIAERPKVRGQAGRMNYYWTLLEPGDTIIFEATGNLIAPWYAFALSRGSGSGIITSNASMHECNTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKSQLRNNAKEIGNGCFEFYHKCDNECMESVKNGTYDYPKYSEESKLNREKIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 328 - protein, 694 aa, Artificial Sequence
  Synthetic polypeptide
MEARLLVLLCAFAATNADTICIGYHANNSTDTVDTVLEKNVTVTHSVNLLEDSHNGKLCRLKGIAPLQLGNCSVAGWILGNPECESLFSKESWSYIAETPNPENGTCFPGYFADYEELREQLSSVSSFERFEIFPKESSWPNHTVTKGVTASCSHNGKSSFYRNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 329 - protein, 693 aa, Artificial Sequence
  Synthetic polypeptide
MEARLLVLLCAFAATNADTICIGYHANNSTDTVDTVLEKNVTVTHSVNLLEDSHNGKLCLLKGIAPLQLGNCSVAGWILGNPECELLISKESWSYIVETPNPENGTCFPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 330 - protein, 695 aa, Artificial Sequence
  Synthetic polypeptide
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVSPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 331 - protein, 695 aa, Artificial Sequence
  Synthetic polypeptide
MKTIIALSHILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTQLNFKYPALNVTMPNNEQFDKLYIWGVHHPVTDKDQIFLYAQSSGRITVSTKRSQQAVIPNIGYRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 332 - protein, 692 aa, Artificial Sequence
  Synthetic polypeptide
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCFPGNFNDYEELKHLLSRINHFEKIQIIPKSSWSDHEASSGVSSACPYQGSPSFFRNVVWLIKKNNTYPTIKRSYNNTNQEDLLVLWGIHHPNDAAEQTRLYQNPTTYISVGTSTLNQRLVPKIATRSKVNGQSGRMEFFWTILKPNDAINFESNGNFIAPEYAYKIVKKGDSAIMKSELEYGNCNTKCQTPIGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 333 - protein, 692 aa, Artificial Sequence
  Synthetic polypeptide
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCFPGNFNDYEELKHLLSRINHFEKIQIIPKSSWSDHEASSGVSSACPYQGRSSFFRNVVWLIKKNNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQIETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 334 - protein, 692 aa, Artificial Sequence
  Synthetic polypeptide
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCFPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 335 - protein, 692 aa, Artificial Sequence
  Synthetic polypeptide
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCFPGNFNDYEELKHLLSRINHFEKIQIIPKSSWSDHEASSGVSSACPYQGRSSFFRNVVWLIKKNSTYPTIKRSYNNTNQEDLLVLWGIHHPNDAAEQTRLYQNPTTYISVGTSTLNQRLAPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 336 - protein, 713 aa, Artificial Sequence
  Synthetic polypeptide
MDTLLLWVLLLWVPGSTGDRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASSGRSSGGDIIKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKSGS

SEQ ID NO: 337 - protein, 705 aa, Artificial Sequence
  Synthetic polypeptide
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASSGGDIIKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKSGS

SEQ ID NO: 338 - protein, 701 aa, Artificial Sequence
  Synthetic polypeptide
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITSGGDIIKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 339 - protein, 703 aa, Artificial Sequence
  Synthetic polypeptide
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITASGGDIIKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKSGS

SEQ ID NO: 340 - protein, 404 aa, Artificial Sequence
  Synthetic polypeptide
MKTIIALSYILCLVFAQKLPGNDNSTATLCLGHHAVPNGTIVKTITNDQIEVTNATELVFPGCGVLKLATGMRNVPEKQTRGIFGAIAGFIENGWEGMVDGWYGFRHQNSEGIGQAADLKSTQAAINQINGMVNRVIELMEQGGPDCYLAELLVALLNQHVIDLTDSEMRKLFERTKKQLRENAEDMGNGCFKIYHKCDNACIGSIRNGTYDHDVYRDEALNNRFQIKSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 341 - protein, 397 aa, Artificial Sequence
  Synthetic polypeptide
MNTQILVFALIAIIPTNADKICLGHHAVSNGTKVNTLTERGVEVVNATELVFPGCGVLKLATGMKNVPEIPKGRGLFGAIAGFIENGWEGLIDGWYGFRHQNAQGEGTAADYKSTQSAIDQITGMVNRVIELMEQGGPDCYLAELLVAMLNQHVIDLADSEMDKLYERVKRQLRENAEEDGTGCFEIFHKCDDDCMASIRNNTYDHSKYREEAMQNRIQIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 342 - protein, 396 aa, Artificial Sequence
  Synthetic polypeptide
MYKIVVIIALLGAVKGLDKICLGHHAVANGTIVKTLTNEQEEVTNATELVFPGCGVLMLATGMRNVPELIQGRGLFGAIAGFLENGWEGMVDGWYGFRHQNAQGTGQAADYKSTQAAIDQITGMVNRVVELMEQGGPDCYLAELLVAMLNQHVIDMADSEMRNLYERVRKQLRQNAEEDGKGCFEIYHACDDSCMESIRNNTYDHSQYREEALLNRLNINSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 343 - protein, 391 aa, Artificial Sequence
  Synthetic polypeptide
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDSGGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 344 - protein, 7 aa, Tobacco etch virus
ENLYFQG

SEQ ID NO: 345 - DNA, 22 bp, Artificial Sequence
  Synthetic oligonucleotide
tgactgtgaacgttcgagatga

SEQ ID NO: 346-400 - skipped (55 entries)

SEQ ID NO: 401 - protein, 630 aa, Artificial Sequence
  Synthetic polypeptide
MDSKGSSQKGSRLLLLLVVSNLLLPQGVLAEAALLVCQYTIQSLIHLTGEDPGFFNVEIPEFPFYPTCNVCTADVNVTINFDVGGKKHQLDLDFGQLTPHTKAVYQPRGAFGGSENATNLFLLELLGAGELALTMRSKKLPINVTTGEEQQVSLESVDVYFQDVFGTMWCHHAEMQNPVYLIPETVPYIKWDNCNSTNITAVVRAQGLDVTLPLSLPTSAQDSNFSVKTEMLGNEIDIECIMEDGEISQVLPGDNKFNITCSGYESHVPSGGILTSTSPVATPIPGTGYAYSLRLTPRPVSRFLGNNSILYVFYSGNGPKASGGDYCIQSNIVFSDEIPASQDMPTNTTDITYVGDNATYSVPMVTSEDANSPNVTVTAFWAWPNNTETDFKCKWTLTSGTPSGCENISGAFASNRTFDITVSGLGTAPKTLIITRTATNATTTTHKVIFSKAPEGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 402 - protein, 1032 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGGGSGGGSGGGSGGGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 403 - protein, 1001 aa, Artificial Sequence
  Synthetic polypeptide
METDTLLLWVLLLWVPGSTGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRGGGSGGGSGGGSGGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGGGSGGGSGGGSGGGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 404 - protein, 892 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSGYIPEAPRDGQAYVRKDGEWVLLSTFLGSGSGSGLVPRGSGAGGGHHHHHH

SEQ ID NO: 405 - protein, 861 aa, Artificial Sequence
  Synthetic polypeptide
METDTLLLWVLLLWVPGSTGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRGGGSGGGSGGGSGGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSGYIPEAPRDGQAYVRKDGEWVLLSTFLGSGSGSGLVPRGSGAGGGHHHHHH

SEQ ID NO: 406 - protein, 863 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSGSGSGLVPRGSGAGGGHHHHHH

SEQ ID NO: 407 - protein, 832 aa, Artificial Sequence
  Synthetic polypeptide
METDTLLLWVLLLWVPGSTGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRGGGSGGGSGGGSGGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSGSGSGLVPRGSGAGGGHHHHHH

SEQ ID NO: 408 - protein, 870 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSGSGSGLVPRGSGAGGGHHHHHH

SEQ ID NO: 409 - protein, 852 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSGSGSGLVPRGSGAGGGHHHHHH

SEQ ID NO: 410 - protein, 1007 aa, Artificial Sequence
  Synthetic polypeptide
METDTLLLWVLLLWVPGSTGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGGGSGGGGSGGGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGGGSGGGSGGGSGGGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 411 - protein, 881 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSGYIPEAPRDGQAYVRKDGEWVLLSTFLGSGSGSGLVPRGSGAGGGHHHHHH

SEQ ID NO: 412 - protein, 899 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSGYIPEAPRDGQAYVRKDGEWVLLSTFLGSGSGSGLVPRGSGAGGGHHHHHH

SEQ ID NO: 413 - protein, 1021 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGGGSGGGSGGGSGGGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 414 - protein, 1039 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGGGSGGGSGGGSGGGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 415 - protein, 838 aa, Artificial Sequence
  Synthetic polypeptide
METDTLLLWVLLLWVPGSTGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGGGSGGGGSGGGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSGSGSGLVPRGSGAGGGHHHHHH

SEQ ID NO: 416 - protein, 867 aa, Artificial Sequence
  Synthetic polypeptide
METDTLLLWVLLLWVPGSTGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGGGSGGGGSGGGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSGYIPEAPRDGQAYVRKDGEWVLLSTFLGSGSGSGLVPRGSGAGGGHHHHHH

SEQ ID NO: 417 - protein, 1019 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASAEAAAKEAAAKAGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGGGSGGGSGGGSGGGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 418 - protein, 1025 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASAEAAAKEAAAKEAAAKASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGGGSGGGSGGGSGGGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 419 - protein, 1065 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGSASSGASASGSSGSGSGSGSSSASSGASSGGASGGGSGGSGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 420 - protein, 1065 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGSASSGASASGSSCSGSGSGSSSASSGASSGGASGGGSGGSGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 421 - protein, 1366 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGSASSGASASGSSGSGSGSGSSSASSGDSKGSSQKGSRLLLLLVVSNLLLPQGVLAYFLPPRVRGGGRVAAAAITWVPKPNVEVWPVDPPPPVNFNKTAEQEYGDKEVKLPHWTPTLHTFQVPQNYTKANCTYCNTREYTFSYKGCCFYFTKKKHTWNGCFQACAELYPCTYFYGPTPDILPVVTRNLNAIESLWVGVYRVGEGNWTSLDGGTFKVYQIFGSHCTYVSKFSTVPVSHHECSFLKPCLCVSQRSNSGGSGSASSGASASGSSGSGSGSGSSSASSGASSGGASGGSGGSGGGSGSASSGASASGSSGSGSGSGSSSASSGASSGGASGGSGGSGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 422 - protein, 1065 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRAHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGSASSGASASGSSGSGSGSGSSSASSGASSGGASGGGSGGSGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 423 - protein, 1065 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRAHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGGGSGSASSGASASGSSCSGSGSGSSSASSGASSGGASGGGSGGSGESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 424 - protein, 648 aa, Artificial Sequence
  Synthetic polypeptide
MDSKGSSQKGSRLLLLLVVSNLLLPQGVLAEAALLVCQYTIQSLIHLTGEDPGFFNVEIPEFPFYPTCNVCTADVNVTINFDVGGKKHQLDLDFGQLTPHTKAVYQPRGAFGGSENATNLFLLELLGAGELALTMRSKKLPINVTTGEEQQVSLESVDVYFQDVFGTMWCHHAEMQNPVYLIPETVPYIKWDNCNSTNITAVVRAQGLDVTLPLSLPTSAQDSNFSVKTEMLGNEIDIECIMEDGEISQVLPGDNKFNITCSGYESHVPSGGILTSTSPVATPIPGTGYAYSLRLTPRPVSRFLGNNSILYVFYSGNGPKASGGDYCIQSNIVFSDEIPASQDMPTNTTDITYVGDNATYSVPMVTSEDANSPNVTVTAFWAWPNNTETDFKCKWTLTSGTPSGCENISGAFASNRTFDITVSGLGTAPKTLIITRTATNATTTTHKVIFSKAPEGSTQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 425 - protein, 1039 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSTQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 426 - protein, 669 aa, Artificial Sequence
  Synthetic polypeptide
MDSKGSSQKGSRLLLLLVVSNLLLPQGVLAEAALLVCQYTIQSLIHLTGEDPGFFNVEIPEFPFYPTCNVCTADVNVTINFDVGGKKHQLDLDFGQLTPHTKAVYQPRGAFGGSENATNLFLLELLGAGELALTMRSKKLPINVTTGEEQQVSLESVDVYFQDVFGTMWCHHAEMQNPVYLIPETVPYIKWDNCNSTNITAVVRAQGLDVTLPLSLPTSAQDSNFSVKTEMLGNEIDIECIMEDGEISQVLPGDNKFNITCSGYESHVPSGGILTSTSPVATPIPGTGYAYSLRLTPRPVSRFLGNNSILYVFYSGNGPKASGGDYCIQSNIVFSDEIPASQDMPTNTTDITYVGDNATYSVPMVTSEDANSPNVTVTAFWAWPNNTETDFKCKWTLTSGTPSGCENISGAFASNRTFDITVSGLGTAPKTLIITRTATNATTTTHKVIFSKAPEGSADTCYNDVALDCGITSNSLALPRCNAVYGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 427 - protein, 1060 aa, Artificial Sequence
  Synthetic polypeptide
MRAVGVFLAICLVTIFVLPTWGNWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGGGGSGSASSGASASGSSNGSGSGSGSNSSASSGASSGGASGGSGGSGAASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERASGSADTCYNDVALDCGITSNSLALPRCNAVYGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 428 - protein, 16 aa, Artificial Sequence
  Synthetic peptide
GGGGSGGGGSGGGGSG

SEQ ID NO: 429 - protein, 28 aa, Artificial Sequence
  Synthetic peptide
GGSGSGSNSSASSGASSGGASGGSGGSG

SEQ ID NO: 430 - protein, 46 aa, Artificial Sequence; identical to SEQ ID NO: 222
  Synthetic polypeptide

SEQ ID NO: 431 - protein, 26 aa, Artificial Sequence
  Synthetic peptide
GGSGSASAEAAAKEAAAKAGGSGGSG

SEQ ID NO: 432 - protein, 32 aa, Artificial Sequence; identical to SEQ ID NO: 224
  Synthetic polypeptide

SEQ ID NO: 433 - protein, 47 aa, Artificial Sequence; identical to SEQ ID NO: 225
  Synthetic polypeptide

SEQ ID NO: 434 - protein, 228 aa, Epstein Barr Virus
DSKGSSQKGSRLLLLLVVSNLLLPQGVLAYFLPPRVRGGGRVAAAAITWVPKPNVEVWPVDPPPPVNFNKTAEQEYGDKEVKLPHWTPTLHTFQVPQNYTKANCTYCNTREYTFSYKGCCFYFTKKKHTWNGCFQACAELYPCTYFYGPTPDILPVVTRNLNAIESLWVGVYRVGEGNWTSLDGGTFKVYQIFGSHCTYVSKFSTVPVSHHECSFLKPCLCVSQRSNS

SEQ ID NO: 435 - DNA, 22 bp, Artificial Sequence
  Synthetic oligonucleotide
tgactgtgaacgttcgagatga

SEQ ID NO: 436 - protein, 115 aa, Epstein Barr Virus
NWAYPCCHVTQLRAQHLLALENISDIYLVSNQTCDGFSLASLNSPKNGSNQLVISRCANGLNVVSFFISILKRSSSALTGHLRELLTTLETLYGSFSVEDLFGANLNRYAWHRGG

SEQ ID NO: 437 - protein, 662 aa, Epstein Barr Virus
AASLSEVKLHLDIEGHASHYTIPWTELMAKVPGLSPEALWREANVTEDLASMLNRYKLIYKTSGTLGIALAEPVDIPAVSEGSMQVDASKVHPGVISGLNSPACMLSAPLEKQLFYYIGTMLPNTRPHSYVFYQLRCHLSYVALSINGDKFQYTGAMTSKFLMGTYKRVTEKGDEHVLSLVFGKTKDLPDLRGPFSYPSLTSAQSGDYSLVIVTTFVHYANFHNYFVPNLKDMFSRAVTMTAASYARYVLQKLVLLEMKGGCREPELDTETLTTMFEVSVAFFKVGHAVGETGNGCVDLRWLAKSFFELTVLKDIIGICYGATVKGMQSYGLERLAAMLMATVKMEELGHLTTEKQEYALRLATVGYPKAGVYSGLIGGATSVLLSAYNRHPLFQPLHTVMRETLFIGSHVVLRELRLNVTTQGPNLALYQLLSTALCSALEIGEVLRGLALGTESGLFSPCYLSLRFDLTRDKLLSMAPQEATLDQAAVSNAVDGFLGRLSLEREDRDAWHLPAYKCVDRLDKVLMIIPLINVTFIISSDREVRGSALYEASTTYLSSSLFLSPVIMNKCSQGAVAGEPRQIPKIQNFTRTQKSCIFCGFALLSYDEKEGLETTTYITSQEVQNSILSSNYFDFDNLHVHYLLLTTNGTVMEIAGLYEERA

SEQ ID NO: 438 - protein, 425 aa, Epstein Barr Virus
EAALLVCQYTIQSLIHLTGEDPGFFNVEIPEFPFYPTCNVCTADVNVTINFDVGGKKHQLDLDFGQLTPHTKAVYQPRGAFGGSENATNLFLLELLGAGELALTMRSKKLPINVTTGEEQQVSLESVDVYFQDVFGTMWCHHAEMQNPVYLIPETVPYIKWDNCNSTNITAVVRAQGLDVTLPLSLPTSAQDSNFSVKTEMLGNEIDIECIMEDGEISQVLPGDNKFNITCSGYESHVPSGGILTSTSPVATPIPGTGYAYSLRLTPRPVSRFLGNNSILYVFYSGNGPKASGGDYCIQSNIVFSDEIPASQDMPTNTTDITYVGDNATYSVPMVTSEDANSPNVTVTAFWAWPNNTETDFKCKWTLTSGTPSGCENISGAFASNRTFDITVSGLGTAPKTLIITRTATNATTTTHKVIFSKAPE

SEQ ID NO: 439 - protein, 15 aa, Artificial Sequence
  Synthetic peptide
CLVPRGSLEHHHHHH

SEQ ID NO: 440 - protein, 154 aa, Aquifex aeolicus; identical to SEQ ID NO: 93

SEQ ID NO: 441 - protein, 156 aa, Escherichia coli; identical to SEQ ID NO: 219

SEQ ID NO: 442 - protein, 6 aa, Artificial Sequence
  6xHis tag
HHHHHH

SEQ ID NO: 443 - protein, 4 aa, Artificial Sequence
  Synthetic peptide
GGGS

SEQ ID NO: 444 - protein, 8 aa, Artificial Sequence
  Synthetic peptide
GGGSGGGS

SEQ ID NO: 445 - protein, 20 aa, Artificial Sequence
  Synthetic peptide
GGGSGGGSGGGSGGGSGGGS

SEQ ID NO: 446-500 - skipped (55 entries)

SEQ ID NO: 501 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 502 - protein, 651 aa, Artificial Sequence; identical to SEQ ID NO: 501
  Synthetic polypeptide

SEQ ID NO: 503 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTNNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 504 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKNGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 505 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPTYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 506 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGNVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 507 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFSDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 508 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFINKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 509 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVSKVLHLEGEVNKIKSALLSTNKAVVSLSNGVSVLTFKVLDLKNYIDKQLLPILNKQSCSISNPETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 510 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVSKVLHLEGEVNKIKSALLSTNKAVVSLSNGVSVLTFKVLDLKNYIDKQLLPILNKQSCSISNPETVIEFQQKNLRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 511 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVCKVLHLEGEVNKIKSALLSTNKAVVSLSNGVSVLTFKVLDLKNYIDKQLLPILNKQSCSISNPETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 512 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVCKVLHLEGEVNKIKSALLSTNKAVVSLSNGVSVLTFKVLDLKNYIDKQLLPILNKQSCSISNIETVIEFLQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 513 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVCKVLHLEGEVNKIKSALLSTNKAVVSLSNGVSVLTFKVLDLKNYIDKQLLPILNKQSCSISNIETVIEFLVKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 514 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVCKVLHLEGEVNKIKSALLSTNKAVVSLSNGVSVLTFKVLDLKNYIDKQLLPILNKQSCSISNIETVIEFQQKNLRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 515 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVCKVLHLEGEVNKIKSALLSTNKAVVSLSNGVSVLTFKVLDLKNYIDKQLLPILNKQSCSISNIETVIEFQQKNFRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHKFEGLTQIFQKAYEHEQHISESINNIVDHAIKCKDHATFNFLQWYVAEQHEEEVLFKDILDKIELIGNENHGLYLADQYVKGIAKSRKS

SEQ ID NO: 516 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVSKVLHLEGEVNKIKSALLSTNKAVVSLSNGVSVLTFKVLDLKNYIDKQLLPILNKQSCSISNPETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHCFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 517 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVSKVLHLEGEVNKIKSALLSTNKAVVSLSNGVSVLTFKVLDLKNYIDKQLLPILNKQSCSISNPETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKNGSNICLTRTDRGWYCDNAGNVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFINKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHCFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 518 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVSKVLHLEGEVNKIKSALLSTNKAVVSLSNGVSVLTFKVLDLKNYIDKQLLPILNKQSCSISNPETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKNGSNICLTRTDRGWYCDNAGNVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNELINQSLAFINQSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHCFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 519 - protein, 651 aa, Artificial Sequence
  Synthetic polypeptide
MELLILKANAITTILTAVTFCFASGQNITEEFYQSTCSAVSKGYLSALRTGWYTSVITIELSNIKENKVNGTDAKVKLIKQELDKYKNAVTELQLLMGSGNVGLGGAIASGVAVSKVLHLEGEVNKIKSALLSTNKAVVSLSNGVSVLTFKVLDLKNYIDKQLLPILNKQSVSISNPETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKNGSNICLTRTDRGWYCDNAGNVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFINKSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHCFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 520 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVSKVLHLEGEVNKIKSALLSTNKAVVSLSNGVSVLTFKVLDLKNYIDKQLLPILNKQSCSISNPETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKNGSNICLTRTDRGWYCDNAGNVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNELINQSLAFINQSDELLSGSGSESQVRQQFSNDIENLLNEQVNKEMQSSNLYMSMSSWSYTHSLDGAGLFLFDHAAEEYEHAKKLIIFLNENNVPVQLTSISAPEHCFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 521 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVSKVLHLEGEVNKIKSALLSTNKAVVSLSNGVSVLTFKVLDLKNYIDKQLLPILNKQSCSISNPETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKNGSNICLTRTDRGWYCDNAGNVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGNSLYVNGEPIINFYDPLVFPSDEFDASISQVNELINQSLAFINQSDELLSGSGSESQVRQQFSKDIEKLLNEQVNKEMQSSNLYMSMSSWSYTHSLDGAGLFLFDHAAEEYEHAKKLIIFLNENNVPVQLTSISAPEHCFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 522 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVSKVLHLEGEVNKIKSALLSTNKAVVSLSNGVSVLTFKVLDLKNYIDKQLLPILNKQSCSISNPETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKNGSNICLTRTDRGWYCDNAGNVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGNSLYVNGEPIINFYDPLVFPSDEFDASISQVNELINQSLAFINQSDELLSGSGSESQVRQQFSNDIENLLNEQVNKEMQSSNLYMSMSSWSYTHSLDGAGLFLFDHAAEEYEHAKKLIIFLNENNVPVQLTSISAPEHCFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 523 - protein, 651 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMGSGNVGLGGAIASGVAVSKVLHLEGEVNKIKSALLSTNKAVVSLSNGVSVLTFKVLDLKNYIDKQLLPILNKQSCSISNPETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKNGSNICLTRTDRGWYCDNAGNVSFFPQAETCKVQSNRVFCDTMNSRTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNELINQSLAFINQSDELLSGSGSESQVQQQFSKDIEKLLNEQVNKEMQSSNLYMSMSSWSYTHSLDGAGLFLFDHAAEEYEHAKKLIIFLNENNVPVQLTSISAPEHCFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 524 - protein, 530 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLGLEVLFQGPHHHHHHHHSAWSHPQFEK

SEQ ID NO: 525 - protein, 689 aa, Artificial Sequence
  Synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSGGSSGSSGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 526 - protein, 574 aa, Human respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 527 - protein, 297 aa, Human respiratory syncytial virus
MSKNKDQRTAKTLERTWDTLNHLLFISSCLYKLNLKSVAQITLSILAMIISTSLIIVAIIFIASANHKITSTTTIIQDATNQIKNTTPTYLTQNPQLGISPSNPSDITSLITTILDSTTPGVKSTLQSTTVGTKNTTTTQAQPNKPTTKQRQNKPPSKPNNDFHFEVFNFVPCSICSNNPTCWAICKRIPNKKPGKRTTTKPTKKPTPKTTKKGPKPQTTKSKEAPTTKPTEEPTINTTKTNIITTLLTSNTTRNPELTSQMETFHSTSSEGNPSPSQVSITSEYPSQPSSPPNTPR

SEQ ID NO: 528 - protein, 233 aa, Human respiratory syncytial virus
NHKVTLTTAIIQDATSQIKNTTPTYLTQDPQLGISFSNLSEITSQTTTILASTTPGVKSNLQPTTVKTKNTTTTQTQPSKPTTKQRQNKPPNKPNNDFHFEVFNFVPCSICSNNPTCWAICKRIPNKKPGKKTTTKPTKKPTFKTTKKDHKPQTTKPKEVPTTKPTEEPTINTTKTNIITTLLTNNTTGNPKLTSQMETFHSTSSEGNLSPSQVSTTSEHPSQPSSPPNTTRQ

SEQ ID NO: 529 - protein, 56 aa, Artificial Sequence
  Synthetic polypeptide
SGGSSGSSEEEGGSRQNKPNNDFHFEVFNFVPCSICSNNPTCWAICKRIPNKKEEE

SEQ ID NO: 530 - DNA, 22 bp, Artificial Sequence
  Synthetic oligonucleotide
tgactgtgaacgttcgagatga

SEQ ID NO: 531 - protein, 7 aa, Artificial Sequence
  Synthetic peptide
GSGNVGL

SEQ ID NO: 532 - protein, 5 aa, Unknown
  Monobasic mutation sequence
PQRET

SEQ ID NO: 533 - protein, 5 aa, Artificial Sequence
  Synthetic peptide
SGSGS

SEQ ID NO: 534 - DNA, 21 bp, Artificial Sequence
  Synthetic oligonucleotide
tgactgtgaacgttcgagatg

SEQ ID NO: 535 - DNA, 20 bp, Artificial Sequence
  Synthetic oligonucleotide
tccatgacgttcctgacgtt

SEQ ID NO: 536 - protein, 43 aa, Artificial Sequence
  Synthetic peptide
RQNKPPNKPNNDFHFEVFNFVPCSICSNNPTCWAICKRIPNKK

SEQ ID NO: 537 - protein, 42 aa, Artificial Sequence
  Synthetic peptide
RKNPPKKPKDDYHFEVFNFVPCSICGNNQLCKSICKTIPNKK

We claim:

1. A ferritin protein comprising a mutation replacing an internal cysteine with a non-cysteine amino acid, wherein the internal cysteine is at position 30 of the *H. pylori* ferritin sequence of SEQ ID NO: 209, or is at a position that corresponds to position 30 of the *H. pylori* ferritin sequence of SEQ ID NO: 209 as determined by pair-wise or structural alignment, and further comprising i) a mutation replacing a surface-exposed amino acid with a cysteine, ii) an N- or C-terminal linker comprising a cysteine; or iii) one or more immune-stimulatory moieties linked to the ferritin protein via a surface-exposed amino acid.

2. The ferritin protein of claim 1, which is an antigenic ferritin protein further comprising a non-ferritin polypeptide.

3. The antigenic ferritin protein of claim 2 comprising a mutation replacing a surface exposed amino acid with a cysteine and an immune-stimulatory moiety linked to the cysteine.

4. The antigenic ferritin protein of claim 2 comprising (i) a surface-exposed cysteine, (ii) a peptide linker N-terminal to the ferritin protein, and (iii) a non-ferritin polypeptide N-terminal to the peptide linker.

5. The ferritin protein of claim 1, further comprising a mutation replacing a surface-exposed asparagine with a non-asparagine amino acid.

6. An antigenic ferritin protein comprising:
   a. a mutation replacing the internal cysteine at a position corresponding to position 30 of the *H. pylori* ferritin sequence of SEQ ID NO: 209 as determined by pair-wise or structural alignment, or at an analogous position in a non-*H. pylori* ferritin as determined by pair-wise or structural alignment;
   b. a mutation replacing a surface-exposed asparagine with a non-asparagine amino acid; and
   c. a non-ferritin polypeptide.

7. The antigenic ferritin protein of claim 6, wherein the non-cysteine amino acid is serine.

8. The antigenic ferritin protein of claim 6, wherein the surface-exposed asparagine is at a position corresponding to position 18 of the *H. pylori* ferritin sequence of SEQ ID NO: 209 as determined by pair-wise or structural alignment, or is at an analogous position in the non-*H. pylori* ferritin as determined by pairwise or structural alignment.

9. The antigenic ferritin protein of claim 6, wherein the ferritin comprises one or more of E11C, S25C, S71C, A74C, K78C, S99C, and S110C mutations corresponding to the *H. pylori* ferritin sequence of SEQ ID NO: 209 as determined by pair-wise or structural alignment, or one or more corresponding mutations in a non-*H. pylori* ferritin as determined by pairwise or structural alignment.

10. The ferritin protein of claim 1, comprising an immune-stimulatory moiety that is an agonist of TLR2, TLR7/8, TLR9, or STING.

11. The ferritin protein of claim 1, comprising an amino acid sequence with at least 80% identity to any one of SEQ ID NOs: 201-208, or 211-215.

12. A ferritin particle comprising the ferritin protein of claim 1.

13. A composition comprising a first ferritin protein and a second ferritin protein, wherein the first ferritin protein comprises a ferritin heavy chain and a first non-ferritin polypeptide, the second ferritin protein comprises a ferritin light chain and a second non-ferritin polypeptide, and the first and second non-ferritin polypeptides are different, optionally wherein a ferritin particle comprises the first ferritin protein and the second ferritin protein.

14. A nucleic acid encoding the ferritin protein of claim 1, wherein the nucleic acid is an mRNA or DNA.

15. The antigenic ferritin protein of claim 6, further comprising a linker sequence.

16. The antigenic ferritin protein of claim 15, wherein the linker sequence comprises a sequence having at least 80% sequence identity to SEQ ID NO: 217.

* * * * *